US006768041B2

(12) United States Patent
Strabala et al.

(10) Patent No.: US 6,768,041 B2
(45) Date of Patent: Jul. 27, 2004

(54) COMPOSITIONS ISOLATED FROM PLANT CELLS AND THEIR USE IN THE MODIFICATION OF PLANT CELL SIGNALING

(75) Inventors: Timothy Strabala, Auckland (NZ); Nicolaas Nieuwenhuizen, Auckland (NZ)

(73) Assignee: Genesis Research and Development Corporation Limited, Auckland (NZ)

( * ) Notice: Subject to any disclaimer, the term of this patent is extended or adjusted under 35 U.S.C. 154(b) by 0 days.

(21) Appl. No.: 10/101,464

(22) Filed: Mar. 18, 2002

(65) Prior Publication Data

US 2003/0046728 A1 Mar. 6, 2003

Related U.S. Application Data

(63) Continuation-in-part of application No. 09/704,302, filed on Nov. 1, 2000, which is a continuation-in-part of application No. PCT/US00/00724, filed on Jan. 11, 2000, which is a continuation of application No. 09/228,986, filed on Jan. 12, 1999, now Pat. No. 6,359,198.
(60) Provisional application No. 60/162,866, filed on Nov. 1, 1999.

(51) Int. Cl.$^7$ .................. C12N 15/82; C12N 15/29; C12N 15/87; C12N 5/10; A01H 5/00
(52) U.S. Cl. .................. 800/278; 800/287; 800/298; 800/290; 800/319; 536/23.6; 536/23.1; 435/468; 435/419; 435/320.1
(58) Field of Search .................. 800/278, 287, 800/298, 290, 319; 536/23.6, 23.1; 435/468, 419, 320.1

(56) References Cited

U.S. PATENT DOCUMENTS

| | | | | |
|---|---|---|---|---|
| 5,122,466 A | * | 6/1992 | Stomp et al. | 435/172.3 |
| 5,451,514 A | * | 9/1995 | Boudet et al. | 435/175.3 |
| 5,484,905 A | | 1/1996 | Nasrallah et al. | 536/23.6 |
| 5,650,553 A | | 7/1997 | Ecker et al. | 800/205 |
| 5,689,055 A | * | 11/1997 | Meyerowitz et al. | 800/205 |
| 5,766,878 A | | 6/1998 | Wallis | 435/69.1 |

OTHER PUBLICATIONS

Christensen et al (2000, Cell 100:469–478).*
Bowie et al (1990, Science 247:1306–10).*
McConnell et al (2001, Nature 411 (6838):709–713).*
Feng et al (May, 1997. NCBI Database Accession No. B10062.1).*
Kano–Murakami et al (1993, FEBS 334:365–368).*
Strabala et al (Jul. 20, 2000, WO200042171–A1) as listed on Sequence Search result).*
Bork, "Go hunting in sequence databases but watch out for the traps", 1996, TIG vol. 12 No. 10 pp. 425–427.*
Smith et al, The challenges of genome sequence annotation or "The devil is in the details", 1997, Nature Biotechnology vol. 15 pp. 1222–1223.*
Brenner, "Errors in genome annotation", 1999, TIG vol. 15 No. 4 pp. 132–133.*
Chang et al, "Arabidopsis Ethylene–Response Gene ETR1: Similarity of Product to Two–Component Regulators", 1993 Science vol. 262 pp. 539–544.*
Doerks, "Protein annotation" detective work for function prediction, 1998, TIG vol. 14 No. 6 pp. 248–250.*
Smith et al. Nature 1988. vol. 334: 724–726, 1988.*
Martin et al. Science. 1993. vol. 262: 1432–1436, 1993.*
Maeda, Tatsuya et al., "A two–component system that regulates an osmosensing MAP kinase cascade in yeast," *Nature*, vol. 369, pp. 242–245 (May 19, 1994).
Alex, Lisa A. et al., "Hyphal development in *Neurospora crassa*: Involvement of a two–component histidine kinase," *Proc. Natl. Acad. Sci. USA*, vol. 93, pp. 3416–3421 (Apr., 1996).
Chang, Caren et al., "*Arabidopsis* Ethylene–Response Gene ETR1: Similarity of Product to Two–Component Regulators," *Science*, vol. 262, pp. 539–544 (Oct. 22, 1993).
Brandstatter, Ingrid et al., "Two Genes with Similarity to Bacterial Response Regulators Are Rapidly and Specifically Induced by Cytokinin in Arabidopsis," *The Plant Cell*, vol. 10, pp. 1009–1019 (Jun., 1998).
Kakimoto, Tatsuo, "CKI1, a Histidine Kinase Homolog Implicated in Cytokinin Signal Transduction," *Science*, vol. 274, pp. 982–985 (Nov. 8, 1996).
Song, Wen–Yuen, et al., "A receptor Kinase–Like Protein Encoded by the Rice Disease Resistance Gene, Xa21," *Science*, vol. 270, pp. 1804–1806 (Dec. 15, 1995).
He, Zheng–Hui, et al., "Requirement for the induced expression of a cell wall associated receptor kinase for survival during the pathogen response," *The Plant Journal*, vol. 14(1), pp. 55–63 (1998).
Sachs, Alan B., "Cell Cycle–Dependent Translation Initiation: IRES Elements Prevail", *Cell*, vol. 101, pp. 243–245 (2000).
Suzuki, Tomomi et al., "The Arabidopsis Sensor His–kinase, AHK4, Can Respond to Cytokinins", *Plant Cell Physiol.*, vol. 42, No. 2, pp. 107–113 (2001).
Inoue, Tsutomu et al., "Identification of CRE1 as a cytokinin receptor from *Arabidopsis*", *Nature*, vol. 409, pp. 1060–1063 (2001).

(List continued on next page.)

Primary Examiner—David T. Fox
Assistant Examiner—Stuart F. Baum
(74) Attorney, Agent, or Firm—Ann W. Speckman; Janet Sleath

(57) ABSTRACT

Novel isolated polynucleotides that encode polypeptides involved in plant cell signaling are provided, together with genetic constructs comprising such polynucleotides. Methods for using such constructs for the modulation of cell signaling in plants are also disclosed, together with transgenic plants comprising such constructs.

18 Claims, 28 Drawing Sheets

OTHER PUBLICATIONS

Sweere, Uta et al., "Interaction of the Response Regulator ARR4 with Phytochrome B in Modulating Red Light Signaling", *Science*, vol. 294, pp. 1108–1111 (2001).

Sakai, Hiroe et al., "ARR1, a Transcription Factor for Genes Immediately Responsive to Cytokinins", *Science*, vol. 294, pp. 1519–1521 (2001).

Bugos, Robert C., et al., "cDNA Cloning. Sequence Analysis and Seasonal Expression of Lignin–Bispecific Caffeic Acid/ 5–Hydroxyferulic Acid O–Methyltransferase of Aspen," *Plant Molecular Biology*, vol. 17, pp. 1203–1215 (1991).

Dwivedi, Upendra N., et al., "Modification of Lignin Biosynthesis in Transgenic *Nicotiana* Through Expression of an Antisense O–Methyltransferase Gene from *Populus,*" *Plant Molecular Biology*, vol. 26, pp. 61–71 (1994).

Sakai, Hajime et al., "ETR2 is an ETR1–like gene involved in ethylene signaling in Arabidopsis," *Proc. Natl. Acad. Sci.*, vol. 95, pp. 5812–5817 (May, 1998).

Smith et al., Nature, 1988, vol. 334: 724–726.

Martin, et al., Science, 1993, vol. 262: 1432–1438.

Bork, "Go hunting in sequence databases buh watch out for the traps", TIG. 1998, vol. 12, No. 10, pp. 425–427.

Smith, et al., "The challenges of genome sequence annotation of the devil is in the details", Nature Biotechnology. 1997. vol. 15, pp. 1222–1223.

Brenner, "Errors in genome annotation", TIG, 1999, vol. 15, No. 4, pp. 132–133.

Chang, et al., "Arabidopsis Ethylene–Response Gene ETR1: Similarity of Product to Two–Component Regulators", Science, 1993, vol. 262, pp. 539–544.

\* cited by examiner

Figure 1A

```
MEEAFLRLIF LVAVLLFG KD LQLVFSFTNP DDSVALQSLK MSWQNTPPSW ERSSDPCGLP    60
Signal peptide
WEGVTCNSNS RVTSLGLSTM GIKGQLISE I AGLAELRSLD LSFNKELTGP LARQLGNLQK   120

LNILILAGCS FTGSIPDELG NLAELSFLAL NSNNLTGNIP ASLGNLSKLY WFDLADNQLT    180
           Leucine-rich Repeat Region
GPIPISTDTS PGLDLLLKAK HFHFNKNKLS GPIPEKLFNS AMVLIHVLFD GNQLNGSIPS    240

SVGLLPDLEV LRLDRNKLSG KVPLNLNNLT NLSELNFAHN ALTGPLPDLT DMNSLNYVDL    300

SNNFFDPSEA PDWFSTLPTL TTLVIEYGPL KGVVPQKLFS FPQLQQVKLK NNEFNGTLNM    360

GDNISPQLQL VDLQNNQISS VTLGS SGYSN TLMLIGNPVC TTELSNTNYC QLQQQTVKPY   420

STSLASCGSK SCPPDERLNP QSCECAFPYE GTLYFRGPSF RELSNVTLFH MLEMDLWTKL    480

NLTPGSVSLQ NPFFNLDDYL QVQLSLFPPS GKYFSRSDIQ SIGFDLTNQT FKPPKPFGPY    540

YFIASPYAFP DNGGTAISKG VIVGIAIGGT VLVLGL VVLG LYAIRQKKRA EKALELSRPF   600
                              Transmembrane domain
ASWAPSGKDS GGAPQLKGAR WFSYDELKRC TNNFSDSNEL GFGGYGKVYR G VLPDGHI LA  660
                                            I
IKRA QQGSMQ GATE FKTETE LL SRVH HKNL VGL IGFCFEQ GEQ MLVYEYM PNGTLRDSLT 720
II              III        IV                     V
GKSGIY LDWK RRLRIALGSA RGLAYLH ELA NPPII HRDVK STNILLDEHL TAK VA DFGLS 780
       VIa                        VIb                        VII
KLVSDSGKGH VSTQVK GTLG YLDPEY YMSQ QLTE KSDVYS FGVVMLEL IT AKQPIEKGKY 840
               VIII                   IX
VVREIRTAMD KNDQDYYGVR EMMDPSMRSM GYLVGFSRFL DLAMR C VEES AAD RPTMSEV  900
         X                                                    XI
VKAI ETMLQN DGIHTNSTSA SSSATDFGST KGAPRHPYND ALPKKEVSYS DSFDYSGGYG   960

LSTKIEPK                                                             968
```

Figure 1B

| | | | | | | | | |
|---|---|---|---|---|---|---|---|---|
| IAG | LAE | LRS | LDLSF | | NKEL | TGP | LARQ | 1 |
| LGN | LQK | LNI | LILAG | | CSFT | GSI | PDE | 2 |
| LGN | LAE | LSF | LALNS | | NNLT | GNI | PAS | 3 |
| LGN | LSK | LYW | FDLAD | | NQLT | GPI | PIS | 4 |
| TDT | SPG | LDL | LLKAK | HFHFNK | NKLS | GPI | PEK | 5 |
| LFNS | AMV | LIH | VLFDG | | NQLN | GSI | PSS | 6 |
| VGL | LPD | LEV | LRLDR | | NKLS | GKV | PLN | 7 |
| LNN | LTN | LSE | LNFAH | | NALT | GPL | PD | 8 |
| LTD | MNS | LNY | VDLSN | | NFFD | PSE | APDW | 9 |
| FST | LPT | LTT | LVIEY | | GPLK | GVV | PQK | 10 |
| LFS | FPQ | LQQ | VKLKN | | NEFN | GTL | NMG | 11 |
| DNI | SPQ | LQL | VDLQN | | NQIS | SVT | LGS | 12 |
| L--. | L-- | L-- | L-L-- | | N--- | G-- | P-- | Consensus |

Figure 2

```
MICLGGIVIV SFLLQNIAMA SEDGGSRCNC DGEGWWNVEN IMQCQMVSDF LIALAYFSIP      60
    Signal Peptide                                        TM
LELLYFLSCS NSLPFRWVIV QFGAFIVLCG LTHFINIWT Y GPQSFHVMLA LTIFKFLTAL    120
Domain I              TM Domain II                              TM
VSCATAITLV TLIPELLRVK VREIFLKNKA RELDREVDIV KRKEETSWHV HMLTQEIRSS     180
  Domain III
LDRHTILNTT LISLAKTLNL ENCTIWMPLA DGTAMEVSHE LKRRHLQVPL TVPTTDPDVK     240

KIMHSEDAIL LSPDSALGKE SNHHWSLAGP VAAIRVPLWK ASNFKSGASV DREESYAIMV     300

LVLPCEDERQ WSSQELYIVK DVAEQVAVAL SHAAVLEESQ KLKAPLIDKN KTLQQAKQDA     360

LRASKARHSF Q LAMNREMRL PMH AISALSS ILQSARLNVE QLAMTNMLAK SSSLLSTLIN   420
               H box
DIMDFSELED TSLVLQLHPF QLHGMLKDAA HLTETMSRSK GLLLNVEIGD GMPDHVIGDE     480

KR ILRIILHM VGNAIN STKQ GTISIRICVE DRAEGWWDPN NRRWRPSLCE GFTYLRFE IR  540
      N box                                                        G1
TSGSGS IQND NP SFLTVV QD GKSDSSSS TG EGLGF AICKK FVQLMHGNIW LEPNSKGEGS 600
  Box         F box              G2 box
VVTFLIRVQL QTSTANKHWL SPDEKIYKSS FKGLKV LVAD DN NVSRSVTR RLLQELGCQT  660
                                          DD box
TEVDSGYRCL MTLLQSGSAF QLVFLEVC LA QMDGYEVAFR IRQKFRSRNR PLVVALTAST   720
                                 D box
DKETMERCLQ T GMDGVIRKP V TLREMSNEL PKIVHQTNNI HE                     762
              KP box
```

Figure 3

```
AVRVPLLHLS NFQINDWPEL STKRYALMVL MLPSDSARQW HVHELELVEV VADQVAVALS         60

HAAILEESMR ARDLLMEQNV ALDLARREAD TAIRARNDFL AVMNHEMRTP MH AIIALSSL       120
                                            H box
LQETELTPEQ RLMVETIMKS SNLLATLIND VLDLSRLEDG SFQLNIATFN LHAVFREVLN        180

LIKPVASVKK LLITLNLAPD LPEYAVGDEK R LMQVILNVV GNAVK FSKEG GISITAFVAK      240
                                       N box
AEYLREARPP EFIPVPSDNH FYLRVQV RDS GSGI NPQDIP KLFTKFA HNQ SLATRNS GGS    300
                             G1 box         F box          G2 box
GLG LAICKRF VTLMDGHIWI ESEGIGKGCT ATFIVGLGIP EKLNESKFPV LPRGSSNHVL       360

ANFSGLKV LV MDDN GVGRAA TKGLLLHLGC DVTTVSSGDE LLHAVSQEHK VVLMDICTPG      420
         DD box
IDSYEVA VQI HRLYSQHHER PLLVAITGST DKVTKENCMR V GMDGVIQKP V SLDKMRNVL    480
D box                                          KP box
SELLECGHQM SSLARV                                                       496
```

Figure 4

```
MEVGQMQRRL VEFTKSLFME DSEKLLNDLT SALEQQNVDF KKVDAHVHQL KGSSSSIGAQ      60

RVKNACVVFR SFCEEQNLEG CMRCLQQV K QEFYLAKNKF ETLFTLEQQI VAAGGSIP AM    120
                              Hpt domain
EITSF                                                                 124
```

Figure 5

```
MEKDPIEDMD IEALPSMWPE DIDNDAGKQF NIENPGGDED MLKEVTIPEE PNIVDIKRLL    60

ELTNYTDQGA SQLAYLVKHW EYRQANAVRL LKEELDILSR QRQEVELKKL EILEEHRFEG   120

ERYGGDKRPI SILDDAFDIW QDVPRRKSDV VIQNKRVEID AEYDTVIYWK QRAMHLEKLL   180

EASIHREQAL MEKLQESINN LEKQSSPVEE LSQILKRADN FLHFILQNAP VVIGHQDKEL   240

RYRFIYNPYP TLNEEDVIGK TDIDIFTGAG VKESQEFKRE VLEKGLPAKR EITFDTELFG   300

AKTFLIHVAP VFSKTGETIG INYMGMDVTD QVRIREKMAK LREEMAVRNA KETEMNKTMY   360

ITEETMRAK|Q MLATMSHEIR SP|LAGVVSMA EILAQTRLDH EQRQLLDVML SSGDLVLQLI   420
              H box
NDILDLSKVE SGVMKLEATK FRPREVVKHV LQTAAASLRK ILTLEGHVAD DVPIEVI |GDV|   480

|LRIRQILTNL ISNAIKFT|HE GKVGINLYVV PEPSVEKTEE CPQKSQADQS TPRENRGKEE   540
    N box
KSSLVCQASC DQQPVQVKSQ NGHLCQNHAL HDNTRIMCES EESADRDKVE EHTPETTVWI   600

C|CDVYDTGIG |T PENALPT|LF KKYMQ|VSADH ARK|YGGTGLG L|AICKQLVEL MGGRLTVSSR   660
  G1 box          F box         G2 box
EHVGSTFTFV LPYKVSPICD NSDDSDDLAI MANHDSAVDD ITDGFFQFQP PTLGSLFSSN   720

GSSRTQKLSS HNVGYTSINN LNRVAEDSYA FPTNNLRLKE LASPEDACSA VDAAETSSET   780

ACSVSPSVHY ECKVDVKNGK VNQLGTECRS QISSSNVSCL EVEKGQVDKL TISELPRSCP   840

ELEKSCASSE STSSSIVEEP KPKPKPK |ILL VEDN|KINVMV TQSMMKQLGH SMDVVNNGVE   900
                              DD box
AVHAVQQST|Y DLILMDVCMP VMNG|LCATRI IRSFEEMGNW DAAVNAGIEL VSSDLSCNGH   980
           D box
SSRESKERVP IIAMTANALS ESADECFAN |G MDSFVSKPV|T FQKLKQCLEQ YLM        1013
                                 KP box
```

Figure 6

```
GKLNHFSPLS HILLLLLLLL SSSESHLIQI LHWSRMGMAA AESR FHVLAV DDN IIDRKLI        60
                                                    DD Box
ERLLKTSSYQ VTTVDSGSKA LEFLGLHEDD RSNSVSPSIS TNNHHQELEV NLIITDYCMP       120

GMTGYDLLKK IKESSS LRDI PVVIM SSENV PARTSRCLEE GAEEFFLKPV R KSDLNRLRP    180
              D Box                             KP Box
HVMKAVSKDQ KQEKHEEEEE EKQEEKEIKS QKHQEQQQQQ HQQQLSPRPS GNSKRKAMEE       240

NLSPDRTRPR YSDIAAVV                                                    258
```

Figure 7

```
MSLLHVLCFG LKVGHLLWVL CCWVVSLIS K NWWVFGGEMT KAGFLGDGGK MSLNWLEKVL       60
  Signal Peptide
GNVYKIHPSH NSQQAGSKKF RKTWWRKVLW TWIIGWFIIS ACIFWYMSSQ AAEKRRE TLG      120
                       Transmembrane domain I
SMCDERARML QDQFNVSMNH VQAMSILIST FHHGKQPSAI DQTTFERYTE RTAFERPLTS      180

FIAYAVRVLH CDREEFEKAQ GWKIKRMDTV EKTPVHKDNS ELEESEPSPV QEEYAPVIFA      240

QDTIGHVVSL DMLSGKEDRE NVLRARASGK GVLTAPFRLI KTNSLGVILT FAVYNKDLPP      300

NATPDERIEA TDGYLGGAFH IESLVEKLLQ QLASKQNIVV NVYDTSNWSH PISMYGSDVS      360

EDYLEHVSTL NFGDPFRKHE MRCRFKQKSP WPWLAITTSF GILVIALLVG YI FQATVNRI     420
                                     Transmembrane domain II
AKVEDDYHKM MELKKRAEAA DVAKS QFLAT VSHEIRTP MN GVLGMLHMLM DTDLDETQQD    480
                             H box
YVRTAQESGK ALVSLINEVL DQAKIESGKI EIEAVQFDLR AILDDVLSLF SGKSQEKRVE      540

LAVYISENVP EKLI GDPGRF RQIITNLMGN SIKFT EKGHI LVTVHLVDEV MNSTDAEMES   600
                N box
ATRSTLSGFP VPDRRLSWAK FRTFSQEGPA SPVPSSFSNP INLI ISVEDT GIG IPPEAQP   660
                                                     G1 box
R VFTRFMQ VG PSISRT HGGT GIGL SISKCL VGLMNGEIGF VSIPQVGSTF TFTAVFDDAC  720
  F box           G2 box
STSKECKGQQ VKCQGDSGTS EFHGMKALVV DTRPVRANVS KYHIQRLGIH VEVVADLNQC     780

LHTIQSGNCR IDMVLLEWEI WDKDSGLSAI FLDKLRDMKP RVSPRLFLLS NSISSSRMSG    840

ATTDATGPFV IMKPLRASML VASFQRVMCV VNRISCSNGE SPSLFLRNLL RGRK ILVVDD   900
                                                              DD box
N KVNLRVAEG ALKKYGADVV CTDSGEKAIA LLRPPH DFDA CFMDIQMPGM D GFEATKRIR  960
                                          D box
QMEQTPSKEF LPGQSSSEPR ENISNFHLPI LAMTADVIHA THEECTKY GM DGYVSKPF EA  1020
                                                     KP box
EQLFREVSRF FPVIIEPKLV ERPP                                          1044
```

Figure 8

```
MDAKTGLLGG DGKISLNWRD KVLGKIVKIQ HQYDHLFGSK KISNALWRKL LYTWVFCATM     60
                                                     Transmembrane
FSLWIFSYMS SQAIEKRKET LASMCDERAQ MLQDQFNVSM NHVQAMSILI STFHHGKSPS    120
Domain I
AIDQTTFAEY TKRTAFERPL TSGVAYAVRV LHSERAEFEK QQGWPIQRMD TLEQNLVHKD    180

DFDPEVLEPS PIQEEYAPVI FAQDTVSHVV SIDLLSGKED RENVLRARAS GKGVLTAPFR    240

LIKTNRLGVI LTFAVYKTDL PSNATPDERI QATAGYIGGI FHIQSLVEKL LQQLASKQNI    300

VLNVLDTTNQ SHPISMYGSD EADDALEYVS TLNFGDPFRK HEMRCRFKQK PPWPWLAITT    360

SYGFLVIAML TGHICYATVN RIAKVEDDYQ KMMEL KKQAE AADIAKS QFL ATVSHEIRTP  420
                 Transmembrane Domain II              H box
MNGVLGMLHM LMHTDLDVTQ QDYVRTAQAS GKALVSLINE VLDQAKIESG KLELEAVQFD    480

LRAILDDVLS LFSGKSQEKG VELAVFISDQ VPEKLI GDPG RFRQIITNLM GNSIKFT EKG  540
                                       N box
HIFVTVHLAQ EVMDSLDVET ESSSKNTLSG FQVAERRLSW AKFKTFSQHE RVCSYPSSTY    600

DLINLI VSVE DTGVG IPFEA QCR VFTPFMQ VGPSISRT HG GTGIGL SISK CLVELMNGEV 660
       G1 box           F box              G2 box
GFVSIPNVGS TFTFTAVFNN GHSNLNEYTC QQMNNQSNSA NSEFEGMSAL VVDPRSVRAK    720

VSKYHVQRLC IQVEIVSDLN QVLSSLKSRK PRIDMVLIEE EVWNNDSDLS ILFVDQLRHI    780

DQKVTPRLFL LAKSISSTRS DNVTCDTHSP AVIMKPLRAS MVAACLQRTM GNMGNKGNYR    840

NGEVSRLSLQ HLLLGRK ILI VDDN KVNLKV AAGALKRYGA ELVCVESGKE AISLLTPPH S 900
               DD box
FYACFMDIQM PGMD GFEATK TIRDVEKSVN RKIQLGEVSA EAHGNVLNWH VPILAMTADV  960
  D box
IHATQEECMK C GMDGYVSKP F EAEQLYREV SRFSYSAESR KL                   1002
              KP box
```

Figure 9

```
MGTPLRKVFE RISGLAYPWR RGRAPQGRHR VFRRDVQQDD FQYASARCLS SYYSVFVARL      60

AIMVMLAILI GLLTILTWH I TKTYTTKSLN SLAYGLRHEL LQRPILRMWN ILNSTVEITT    120
Transmembrane domain I
AQVKLSEYVI RRYSKPDTQA EQVQLYEAMR DVTWALFVSR KALNAITINY RNGFVQAFHR    180

DHRSSNTFYI YSDLMNYSIS TSRPSNLNML SSLHGWNDQT IHGNTSATWY RVSLDPVTGE    240

RIGKPRTILP DDLINIACLS QVPDGVASWH VAVSKYSDSP LLSAALPVWD PSNESIVAVV    300

GVTTALYSVG QLMKELVEFI SGHIYLTSQE GYLLATSSNT PLLINSTKGP KLMMANHSQD    360

QVIQLGAEWL QRTYGNSFPA NHEVHVENAE LDRQHYYIDS FFLNLKRLPM VGVIIIPRKY    420

ILGKVDERAF KTLVILISAS LCTLVIGCLC IFLL TNGVSK EMKLRAELIS HLDARRRAEA   480
                     Transmembrane domain II
SSNYKS QFLA NMSHELRTP M AAVIGLLDIL VCDDCLTNEQ YSTVTQIRKC STALLRLLNN  540
       H box
ILDLSKVESG KLVLEEAEFN LARELEGLVD MFSVQCINHN VETILDLSDD MPKLVR GDSA   600

RVVQIFANLI SNSLKFT PSG HIIIRGWCGN SRTMSDFVKL PLEHKISISS LKTKLKQHGS   660
 N box
HARRASKKDN KVTLW FEVDD TGCG IDPSKW ES VFESFEQ A DPSTTRL HGG TGLGL CIVRT  720
               G1 box           F box           G2 box
LVNKMGGEIK VIKKNGPGTL MRLYLLLNAP VDGTEHNCSV DYAVHNIRVL LAQHGSTGRF    780

IMSGWLRRNG VSTLEASGWN ELTQILQELY QGRNSGAPYR TVNTEHAHEL PRSEVTTFDD    840

IQSEILIIVV DIELLDLNTD IWKEQLNFLD KYHRKAKFAW MLNHDTFNAI KVELRRKGHM    900

LMVNKPLYKA KMIQILDAAI KERNSELLKR ASNSSKSMNK EEDLHECLEI DSEHYEGASS    960

DELDTVETSR SGCTNTSPGE QKQQEGIKTP PALQHRTSNY HSFNSTLLSS DYNNLGNKEE   1020

ACPTSPPLDH PDNAEGRFKC TRSVFSSKEK EDGNSEAQEQ LLISKRPPAK VDSCSSKELD   1080

QKGSLEGLC I LLAEDT PVLQ RVATIMLEKL GAKVIAVGDG LQAVNALNSS L DVDAEDFRT   1140
          DD box                                         D box
TLHLQNANRM PQAG TRSWQP YDLILMDCQM PQMDGYEATK AIRRSEAGSG LHIPIVALTA   1200

HAMSSDEAKC LEV GMDAYLT KPI DYKLMVS TILSLTKGVN                       1240
                KP box
```

Figure 10A

```
GGCACGAGGTCTTGGAGTTTGAGCTCTCTCTCCATCTTTTGAGAGCCATGCTCGTCTCTA          60
TGTGACTCGAGACAAGCTCGTCTTTTTTTGAATTCTTCTTGCTTTCCTCTCTTTAGAAAG         120
CTCTACTACCATTGGGTTTCTAGAGAGAGAGAGAATGTGCGAGTGTGCGTGTGTATGTGT         180
GTGTTTGTAGAGTCTAGAGTGCGCGCGCGCTAGCCTTGAGAAACAGATTTTATCTAACAC         240
CTTTTTTTACTTGTTTTCCCTTTTCATTCGTTGCCCCTTTTCGCTTTCTGTTCTTTCTTT         300
GAATGCTGTCTGCAAAATAATTTCCTTTGGGTTCATCTTTACTCTTTTTGTCCGGAAAAG         360
AGTGCTCCCCGAAAATCATCATTACTTTTGTAATTCAGCTGCGTAAACAAGTCCTGAGCT         420
TTTCTGAGCTATAGCATGAAGTGGGTATCTGGAAAACAAGGAGGAAAAGAAGAGGAACAG         480
CAAGAAGAAGGAAAAGCTCAACAGAGGAGAAGCAGAATCTGACACAAAGCTTTACACAGA         540
GGCAGTGAAAGGATGGGGGTGAAAATGCAACAGAGCCACCATTTGGTGGCCGTGAAGTTG         600
AATGAGCAAGTGGGAACCAAAAGAGGGTACACATTCATTCAGTCGAACAGGGCTTGGATT         660
CCCAAAATCTTGGTCCTTTCGGTGGTGGGGATGGCATTCTTGAGCATGTCGATCTACAGA         720
AAAATGGACGCTGACATCAAGGTGAGGAGGAAGGAGGTGCTGGTTAGCATGTGCGATCAG         780
AGGGCAAGGATGTTGAAGGACCAGTTCAGTGTCAGTGTTAATCATGTTCATGCCTTGGCC         840
ATTCTTGTCTCAACTTTCCATTACTACAAGAACCCATCTGCCATCGATCAGGAAACATTT         900
GCCGAGTACACAGCAAGAACCGCTTTTGAGCGCCCTCTACTGAGCGGTGTGGCGTATGCG         960
GAAAGAGTGACTAATTCGGAGAGGGAGAAATTCGAAGAGCAACATGGATGGACAATTAAG        1020
ACAATGGAGAAGCAGCCTTCTCCTGTTAGAGATGAATATGCGCCCGTCATTTTCTCTCAA        1080
GAAACCGTATCCTACATTGAATCACTTGACATGATGTCAGGAGAGGAGGACAGAGAAAAT        1140
ATTCTAAGGGCGAGGGCAACTGGAAAGGCTGTTCTGACAAGCCCATTCAGGTTGTTGGGC        1200
TCCCACCATTTGGGGGTTGTATTGACGTTTCCCGTGTACAAGTCAAAACTCCCGCCAAAT        1260
CCAACTGTGGAAGAGCGCATTGAGGCAACTGTAGGATATCTTGGAGGAGCATTTGATGTC        1320
GAATCTCTCGTGGAGAATCTACTTGGGCAGCTTGATGGAAATCAGGCAATCTTGGTCAAT        1380
GTATATGATGTGACAAACTCTTCCGAACCACTTATCATGTATGGTCACCAATATCAAGAG        1440
TGTGATACATCCCTTCTACATGAGAGCAAGCTCGACTTTGGTGATCCGTTTAGCAACCAT        1500
CAGATGATTTGTAGATATCATCAGAAGGCACCACCATCATGGACAGCCCTCACTACTGCA        1560
TTTTTTGTCTTTGTGATAGGCTTATTAGTAGGGTATATTTTGTATGGTGCAGCAACTCAC        1620
ATTGTCAAAGTCGAAGATGATTTTCATGAGATGCAGGAACTGAAGGTTCGAGCAGAAGCT        1680
GCTGATGTTGCCAAATCTCAGTTTCTTGCCACTGTTTCTCATGAGATTAGAACTCCAATG        1740
AATGGCATCCTTGGAATGCTTGCTCTGCTTCTTGACACAGAATTGAGTTCTACTCAAAGA        1800
GACTATGCACAAACTGCTCAAATCTGTGGAAAAGCATTAATAGCACTGATAAATCACGTA        1860
CTTGACCGTGCTAAAATTGAAGCGGGCAAGTTAGAGCTAGAGACGGTCCCATTCGACATT        1920
CGATCCATTCTTGATGATGTTCTCTCCCTATTCTCTGAGGAGTCCAGACACAAAGGTATT        1980
GAGCTTGCTGTCTTTGTTGCTGACAAAGTGCCGGAAATTGTCATGGGGGATCCGGGAAGA        2040
TTCAGACAGATAATTACTAACCTTGTTGGAAACTCTGTTAAATTCACCGAGAAGGGACAT        2100
ATATTTGTGAAAGTCCATCTGGCTGACCAAGTAAAGGGTGCGACTAATGCACACGCTAAA        2160
ACTTGCCTAAATGGACGACCAGAGGAAGATATACTGATTTCTGATGGGTCACAGTTGGAA        2220
ACATTGAGTGGATGCGAAGTAGCCGATGAGAGGAACAGTTGGGATACCTTTAACCTTTTG        2280
GTAGCTGAAGACCAGTTCAATTCCGTTGATTCCAACATGACTAGTAACGAAGCTTCTGAA        2340
AATGTCACGGTAATGGTCAGTGTTGAAGATACCGGCATCGGCATTCCATTGCGGGCCCAG        2400
GATCGTGTATTTATGCCCTTCATGCAGGCAGATAGCTCAACTTCTAGAACTTATGGTGGA        2460
ACTGGGATTGGCTTGAGTATTAGCAAGTGTCTGGTTGAGCTGATGGGTGGACACATAAAC        2520
TTCATAAGCCGGCCTCAGATTGGGAGCACATTCTCCTTTACGGCTGTGTTTGGAAGATGC        2580
AAAAGCTTGTGTTTGCTAATGTGAAAAGGACTTTTGAAGATCTTCCTTCTGGTTTTAAA        2640
GGATTGAAAGCAATAGTGGTTGATGGTAAGCCAGTCAGAGCTGCCGTAACTAGATACCAT        2700
TTGAATAGACTTGGCATTAACGTTGAAGTTGCAAGTAGCATCAATGCTATAACAGCTACG        2760
GGCGGGAAAAATGGTTCTCTGACTGCTGGATATCGGCACCCAGACATAATTCTAGTTGAG        2820
AAAGATATGTGGATGTCCAGCATTGACAGCTGGATAAGTTTAACGGTGGCAGACTGGAAA        2880
CAGAATGGCAATTTAATTCAGCTTCCGAAAATCCTCCTCGCAAGCAAATCAGTGCTTCT        2940
GAACTAGAGAAGGCGAAAGCTTCTGGTTTTGCCGATACTGTCATTATGAAACCAGTGAGA        3000
GCAAGCATGCTTGCTGCATGTCTGCAACAGGTTCTGGGCATCGGAAGGAAGAAGCAATTG        3060
CAGAAGGATATGAACATGCGAAATGGATCTAGCGCCCTGCGGAGCCTTCTCTATGGCAAG        3120
AAGATATTGGTGGTCGATGACAACAAGGTTAATCGAAGAGTTGCAGCAGGCGCACTCAAG        3180
```

Figure 10A

```
AAATTTGGGGCCAATGTAGAGTGTGCAGAGAGTGGAAAAGCTGCATTAGAGTTGCTTCAA    3240
CTGCCACATGACTTTGATGCTTGTTTCATGGATATCCAAATGCCTGAAATGGATGGATTT    3300
GAGGCAACACGACAGATTAGGCTGATGGAGAGCCAGGTGAACGAGCAAATGAAAAGTGAA    3360
TCTGCAGTTCAAATCGTAAAAGGGGGTGAGTGGCACATGCCAATATTGGCAATGACGGCA    3420
GACGTGATTCACGCGACTTATGACGAATGCCTTAAATGCGGGATGGACGGGTACGTCTCA    3480
AAGCCCTTTGACGAAGAGAATCTTTACCAGGCGGTTGCCAAATTCTTTAGGACCAAACCC    3540
GTCTAGGACTTGAAAACTTCCAAGTGTCTGGTGAATTCATGGATGTCACAACTCAGATGT    3600
TGCAGTGAAAAAAAGTGACCAGCGATTTTGTATTCTGCTGGTTGGTTTTTCATGTCGATA    3660
ATGGCCCCACTCAAAAATGCCGGCACTGGTAAATTGTTCTTACCTGACTCAAATCATTAT    3720
TTTAACTAGAGTAGAATGAATCGGAGTATTTGTATACTACCATAGAACATCCAGCCCTGC    3780
TTGTCTGTATAGATCTTAAACGAGGGGCGAGGAGTCCAAAAGGTGTATATTTTCATCGTC    3840
GTAAAAAAAAAAAAAATTTTTTCTCAGAAATCTCTGAACCACTTAATACAATCTGGAAAT    3900
GCTCTTTTCAAGCTTTCCTTCATTAAAAAAAAAAAAAAA                        3939
```

Figure 10B

```
MGVKMQQSHH LVAVKLNEQV GTKRGYTFIQ SNRAWIPKIL VLSVVGMA_FL SMSIYRKMDA    60
                                Transmembrane domain I
DIKVRRKEVL VSMCDQRARM LKDQFSVSVN HVHALAILVS TFHYYKNPSA IDQETFAEYT   120
ARTAFERPLL SGVAYAERVT NSEREKFEEQ HGWTIKTMEK QPSPVRDEYA PVIFSQETVS   180
YIESLDMMSG EEDRENILRA RATGKAVLTS PFRLLGSHHL GVVLTFPVYK SKLPPNPTVE   240
ERIEATVGYL GGAFDVESLV ENLLGQLDGN QAILVNVYDV TNSSEPLIMY GHQYQECDTS   300
LLHESKLDFG DPFRKHQMIC RYHQKAPPSW TALTTAFFVF VIGL_LVGYIL YGAATHIVKV   360
                                        Transmembrane domain II
EDDFHEMQEL KVRAEAADVA KS QFLATVSH EIRTP MNGIL GMLALLLDTE LSSTQRDYAQ   420
                          H box
TAQICGKALI ALINEVLDRA KIEAGKLELE TVPFDIRSIL DDVLSLFSEE SRHKGIELAV   480
FVADKVPEIV M GDPGRFRQI ITNLVGNSVK FT EKCHIFVK VHLADQVKGA TNAHAKTCLN   540
              N box
GRPEEDILIS DGSQLETLSG CEVADERNSW DTFNLLVAED QFNSVDSNMT SNEASENVTV   600
M VSVEDTGIG IPLRAQDR VF MPFMQ ADSST SRT YGGTGIG L SISKCLVEL MGGHINFISR   660
  G1 box              F box                  G2 box
PQIGSTFSFT AVFGRCKRLV FANVKRTFED LPSGFKGLKA IVVDGKPVRA AVTRYHLNRL   720
GINVEVASSI NAITATGGKN GSLTAGYRHP DIILVEKDMW MSSIDSWISL TVADWKQNGN   780
LIQLPKILLA SKISASELEK AKASGFADTV IMKPVRASML AACLQQVLGI GRKKQLQKDM   840
NMRNGSSALR SLLYGKK ILV VDDN KVNRRV AAGALKKFGA NVECAESGKA ALELLQLPH D   900
                DD box
FDACFMDIQM PEMD GFEATR QIRLMESQVN EQMKSESAVQ IVKGGFWHMP ILAMTADVIH   960
D box
ATYDECLKC G MDGYVSKPF D EENLYQAVAK FFRTKPV                           997
            KP box
```

Figure 11A

```
GGCACGAGGTCTTGGAGTTTGAGCTCTCTCTCCATCTTTTGAGAGCCATGCTCGTCTCTA      60
TGTGACTCGAGACAAGCTCGTCTTTTTTGAATTCTTCTTGCTTTCCTCTCTTTAGAAAG      120
CTCTACTACCATTGGGTTTCTAGAGAGAGAGAGAATGTGCGAGTGTGCGTGTGTATGTGT     180
GTGTTTGTAGAGTCTAGAGTGCGCGCGCGCTAGCCTTGAGAAACAGATTTTATCTAACAC     240
CTTTTTTTACTTGTTTTCCCTTTTCATTCGTTGCCCCTTTTCGCTTTCTGTTCTTTCTTT     300
GAATGCTGTCTGCAAAATAATTTCCTTTGGGTTCATCTTTACTCTTTTTGTCCGGAAAAG    360
AGTGCTCCCCGAAAATCATCATTACTTTTGTAATTCAGCTGCGTAAACAAGTCCTGAGCT    420
TTTCTGAGCTATAGCATGAAGTGGGTATCTGGAAAACAAGGAGGAAAAGAAGAGGAACAG    480
CAAGAAGAAGCAAAAGCTCAACAGAGGAGAAGCAGAATCTGACACAAAGCTTTACACAGA    540
GGCAGTGAAAGGATGGGGGTGAAAATGCAACAGAGCCACCATTTGGTGGCCGTGAAGTTG    600
AATGAGCAAGTGGGAACCAAAAGAGGGTACACATTCATTCAGTCGAACAGGGCTTGGATT    660
CCCAAAATCTTGGTCCTTTCGGTGGTGGGGATGGCATTCTTGAGCATGTCGATCTACAGA   720
AAAATGGACGCTGACATCAAGGTGAGGAGGAAGGAGGTGCTGGTTAGCATGTGCGATCAG    780
AGGGCAAGGATGTTGAAGGACCAGTTCAGTGTCAGTGTTAATCATGTTCATGCCTTGGCC    840
ATTCTTGTCTCAACTTTCCATTACTACAAGAACCCATCTGCCATCGATCAGGAAACATTT    900
GCCGAGTACACAGCAAGAACCGCTTTTGAGCGCCCTCTACTGAGCGGTGTGGCGTATGCG    960
GAAAGAGTGACTAATTCGGAGAGGGAGAAATTCGAAGAGCAACATGGATGGACAATTAAG   1020
ACAATGGAGAAGCAGCCTTCTCCTGTTAGAGATGAATATGCGCCCGTCATTTTCTCTCAA   1080
GAAACCGTATCCTACATTGAATCACTTGACATGATGTCAGGAGAGGAGGACAGAGAAAT    1140
ATTCTAAGGGCGAGGGCAACTGGAAAGGCTGTTCTGACAAGCCCATTCAGGTTGTTGGGC   1200
TCCCACCATTTGGGGGTTGTATTGACGTTTCCCGTGTACAAGTCAAAACTCCCGCCAAAT   1260
CCAACTGTGGAAGAGCGCATTGAGGCAACTGTAGGATATCTTGGAGGAGCATTTGATGTC   1320
GAATCTCTCGTGGAGAATCTACTTGGGCAGCTTGATGGAAATCAGGCAATCTTGGTCAAT   1380
GTATATGATGTGACAAACTCTTCCGAACCACTTATCATGTATGGTCACCAATATCAAGAG   1440
TGTGATACATCCCTTCTACATGAGAGCAAGCTCGACTTTGGTGATCCGTTTAGGAAGCAT   1500
CAGATGATTTGTAGATATCATCAGAAGGCACCACCATCATGGACAGCCCTCACTACTGCA   1560
TTTTTTGTCTTTGTGATAGGCTTATTAGTAGGGTATATTTTGTATGGTGCAGCAACTCAC   1620
ATTGTCAAAGTCGAAGATGATTTTCATCACATGCAGGAACTGAAGGTTCGAGCAGAAGCT   1680
GCTGATGTTGCCAAATCTCAGTTTCTTGCCACTGTTTCTCATGAGATTAGAACTCCAATG   1740
AATGGCATCCTTGGAATGCTTGCTCTGCTTCTTGACACAGAATTGAGTTCTACTCAAAGA   1800
GACTATGCACAAACTGCTCAAATCTGTGGAAAAGCATTAATAGCACTGATAAATGAGGTA   1860
CTTGACCGTGCTAAAATTGAAGCGGGCAAGTTAGAGCTAGAGACGGTCCCATTCGACATT   1920
CGATCCATTCTTGATGATGTTCTCTCCCTATTCTCTGAGGAGTCCAGACACAAAGCTTGC   1980
TGTCTTTGTTGCTGACAAAGTGCCGGAAATTGTCATGGGGGATCCGGGAAGATTCAGACA   2040
GATAATTACTAACCTTGTTGGAAACTCTGTTAAATTCACCGAGAAGGGACATATATTTGT   2100
GAAAGTCCATCTGGCTGACCAAGTAAAGGGTGCGACTAATGCACACGCTAAAACTTGCCT   2160
AAATGGACGACCAGAGGAAGATATACTGATTTCTGATGGGTCACAGTTGGAAACATTGAG   2220
TGGATGCGAAGTAGCCGATGAGAGGAACAGTTGGGATACCTTTAACCTTTTGGTAGCTGA   2280
AGACCAGTTCAATTCCGTTGATTCCAACATGACTAGTAACGAAGCTTCTGAAAATGTCAC   2340
GGTAATGGTCAGTGTTGAAGATACCGGCATCGGCATTCCATTGCGGGCCCAGGATCGTGT   2400
ATTTATGCCCTTCATGCAGGCAGATAGCTCAACTTCTAGAACTTATGGTGGAACTGGGAT   2460
TGGCTTGAGTATTAGCAAGTGTCTGGTTGAGCTGATGGGTGGACACATAAACTTCATAAG   2520
CCGGCCTCAGATTGGGAGCACATTCTCCTTTACGGCTGTGTTTGGAAGATGCAAAAGGCT   2580
TGTGTTTGCTAATGTGAAAAGGACTTTTGAAGATCTTCCTTCTGGTTTTAAAGGATTGAA   2640
AGCAATAGTGGTTGATGGTAAGCCAGTCAGAGCTGCCGTAACTAGATACCATTTCAATAG   2700
ACTTGGCATTAACGTTGAAGTTGCAAGTAGCATCAATGCTATAACAGCTACGGGCGGGAA   2760
AAATGGTTCTCTGACTGCTGGATATCGGCACCCAGACATAATTCTAGTTGAGAAAGATAT   2820
GTGGATGTCCAGCATTGACAGCTGGATAAGTTTAACGGTGGCAGACTGGAAACAGAATGG   2880
CAATTTAATTCAGCTTCCGAAAATCCTCCTCGCAAGCAAATCAGTGCTTCTGAACTAGA    2940
GAAGGCGAAAGCTTCTGGTTTTGCCGATACTGTCATTATGAAACCAGTGAGAGCAAGCAT   3000
GCTTGCTGCATGTCTGCAACAGGTTCTGGGCATCGGAAGGAAGAAGCAATTGCAGAAGGA   3060
TATGAACATGCGAAATGGATCTAGCGCCCTGCGGAGCCTTCTCTATGGCAAGAAGATATT   3120
GGTGGTCGATGACAACAAGGTTAATCGAAGAGTTGCAGCAGGCGCACTCAAGAAATTTGG   3180
```

Figure 11A

```
GGCCAATGTAGAGTGTGCAGAGAGTGGAAAAGCTGCATTAGAGTTGCTTCAACTGCCACA      3240
TGACTTTGATGCTTGTTTCATGGATATCCAAATGCCTGAAATGGATGGATTTGAGGCAAC      3300
ACGACAGATTAGGCTGATGGAGAGCCAGGTGAACGAGCAAATGAAAAGTGAATCTGCAGT      3360
TCAAATCGTAAAAGGGGGTGAGTGGCACATGCCAATATTGGCAATGACGGCAGACGTGAT      3420
TCACGCGACTTATGACGAATGCCTTAAATGCGGGATGGACGGGTACGTCTCAAAGCCCTT      3480
TGACGAAGAGAATCTTTACCAGGCGGTTGCCAAATTCTTTAGGACCAAACCCGTCTAGGA      3540
CTTGAAAACTTCCAAGTGTCTGGTGAATTCATGGATGTCACAACTCAGATGTTGCAGTGA      3600
AAAAAAGTGACCAGCGATTTTGTATTCTGCTGGTTGGTTTTTCATGTCGATAATGGCCCC      3660
ACTCAAAAATGCCGGCACTGGTAAATTGTTCTTACCTGACTCAAATCATTATTTTAACTA      3720
GAGTAGAATGAATCGGAGTATTTGTATACTACCATAGAACATCCAGCCCTGCTTGTCTGT      3780
ATAGATCTTAAAGGAGGGGCGAGGAGTCCAAAAGGTGTATATTTTCATCGTCGTAAAAAA      3840
AAAAAAAATTTTTTCTCAGAAATCTCTGAACCACTTAATACAATCTGGAAATGCTCTTTT      3900
CAAGCTTTCCTTCATTAAAAAAAAAAAAAAA
```

Figure 11B

```
MGVKMQQSHH LVAVKLNEQV GTKRGYTFIQ SNRAWIPKIL VLSVVGMAFL  SMSIYRKMDA    60
                                            Transmembrane domain I
DIKVRRKEVL VSMCDQRARM LKDQFSVSVN HVHALAILVS TFHYYKNPSA IDQETFAEYT   120

ARTAFERPLL SGVAYAERVT NSEREKFEEQ HGWTIKTMEK QPSPVRDEYA PVIFSQETVS   180

YIESLDMMSG EEDRENILRA RATGKAVLTS PFRLLGSHHL GVVLTFPVYK SKLPPNPTVE   240

ERIEATVGYL GGAFDVESLV ENLLGQLDGN QAILVNVYDV TNSSEPLIMY GHQYQECDTS   300

LLHESKLDFG DPFRKHQMIC RYHQKAPPSW TALTTAFFVF VIGLLVGYI L YGAATHIVKV   360
                                            Transmembrane domain II
EDDFHEMQEL KVRAEAADVA KS QFLATVSH EIRTP MNGIL GMLALLLDTE LSSTQRDYAQ   420
                       H box
TAQICGKALI ALINEVLDRA KIEAGKLELE TVPFDIRSIL DDVLSLFSEE SRHKACCLCC   480
```

Figure 12

| | | | | | | |
|---|---|---|---|---|---|---|
| MSLSPLVGVL | LRLSTLFVEW | PMGKMHPNGK | LAGSNGKLQA | SFKLDKGNAP | IKAHNCMERW | 60 |
| RRKLIFVCLL | LMVVSGFVWF | FSGFSESSLV | GKAKDPELWE | EKARIFIQHF | NVSKNQLHAL | 120 |
| VSLLDDSKQV | ASIQCSKLLK | EMGKEMAFIN | GCACSLKVDC | SEHLDLLKQQ | VLNGEDAEFE | 180 |
| DQCPVQPENL | SWEDCLSMLQ | EKSIATASLS | EISFQSVNNP | NFLEDMSQAR | GKGNHAGDSC | 240 |
| GTRSFGLVKG | CWWVIFVMIV | ICKVCGFYMR | VQRDQTQKTV | KPKPVSQQRE | LLLQQRQQQQ | 300 |
| NHSSSKSAGR | WRKKLLIVFV | VAGVMTSIWL | FWHL YAKNVL | RREETLANMC | DERARMLQDQ | 360 |

Transmembrane domain I

| | | | | | | |
|---|---|---|---|---|---|---|
| FNVSMNHVHA | LAILVSTFHH | GKQPSAIDQK | TFGEYTERTA | FERPLTSGVA | YALKVPHSER | 420 |
| EQFEKRHDWT | IKKMETADQT | LVPDYMLDRL | DPAPIQDEYA | PVVFSQETVS | HIVSIDMMSG | 480 |
| KEDRENILRA | RASGKGVLTS | PFKLLKSNHL | GVVLTFAVYD | RELPADATAE | QRIEATVGYL | 540 |
| GASYDVPSLV | EKLLHQLASK | QTIVVNVYDT | TNGSAPINMY | GDDVIDTGLV | RVSNVDFGDP | 600 |
| LRRHEMHCRF | KQRPPLPWTA | INSSVGLLVI | TLLVGHIFHA AI | NRIAKVEE | DYRQMMELKS | 660 |

Transmembrane domain II

| | | | | | | |
|---|---|---|---|---|---|---|
| RAEAADVAKS | QFLATVSHEI RTP | MNGVLAM | LQMLMDTNLN | ANQLDYAQTA | HACGKDLISL | 720 |

H box

| | | | | | | |
|---|---|---|---|---|---|---|
| INEVLDQAKI | ESGRLELEKV | PFDLRLALDN | VLSLISGRSN | EKGIELAVYV | SDRVPEAVI G | 780 |
| DPGRFRQIIT NLVGNSIKFT | HEGHIFVSVH | LLEEGCSQHD | FRDVEKRLSS | NLVEDTSDKT | | 840 |

N box

| | | | | | | |
|---|---|---|---|---|---|---|
| FNTLSGFQVV | DRRKSWERFK | KLNRSDQIDV | NESVEVL VTV EDTGVG | IARE AQSR | IFTPFV | 900 |

G1 box   F box

| | | | | | | |
|---|---|---|---|---|---|---|
| QADSSTSRT Y GGTGIGL SIS | KCLVDLMHGE | IGFVSEPGTG | STFSFTVPFA | KCEMNCLEVK | | 960 |

G2 box

| | | | | | | |
|---|---|---|---|---|---|---|
| GQNYDSIISE | FRGLRALVID | KRHIRAEVAR | YHLERLRISV | DVACSLKSAC | TYLSNSSSPR | 1020 |
| ELSDFDMVLI | DKDVWDRQTG | LELNISLWKH | RQNGSNGVSI | RPKIFLLATS | ISPIEHSELK | 1080 |
| LANLVDNVLA | KPLRLSVLIS | FLQEALGNGK | KRLSDRRKVS | TLGSLLKGRR | ILVVDDN LVN | 1140 |

DD box

| | | | | | | |
|---|---|---|---|---|---|---|
| RRVAEGALKK | YGAIVTCVGS | GKDAVAKLQP | PH DFAACFMD | LQMPEMD GFE | ATRQTRHLES | 1200 |

D box

| | | | | | | |
|---|---|---|---|---|---|---|
| EVNSKIASGE | VSSDAFQNVV | HWHTPILAMT | ADVIQATNEE | CLKC GMDDYV SKPF | EEEQLY | 1260 |

KP box

| | |
|---|---|
| SAVARFFESG | 1270 |

Figure 13

```
MGMAAAESRF HV LAVDDNII  DRKLIERLLK TSSYQVTTVD SGSKALEFLG LHEDDRSNSG        60
              DD box
SPSILTNNHH QELEVNLIIT DYCMPGMTGY DLLKKIKESS S LRDIPVVIM  SSENVPARIS      120
                                              D box
RCLEE GAEEF FLKPVR KSDL NRLRPHVMKA VSKDQKQEKH EEEEEEEKQE EKEIKSQKHQ      180
      KP box
EQQQQQHQQQ LSPRPSGNSK RKAMEENLSP DRTRPRYSDI AAVV                         224
```

Figure 14

```
MSPVEVARNA IEDARAICLR EYGSAPDINI YGDPSFTFPY VPTHLHLMVF ELVKNSLRAV      60
                                            H box
QERFMDSDKV APPIRIIVAD GDEDVTIKVS DEGGGIPRSG LPKIFTYLYS T AKNPLDENS    120
                                                         N box
DLGIADNVTM AGYGYGLPIS RLYARYF GGD LQIISMEGYG TDAYLHLSRL ADSQEPLP      178
           G1 box            G2 box
```

Figure 15

```
ADPKLSEAYL HRASTLRRLC RYQESESSYR EFLELKPGNK AAEKELSQLF QARSALESAI      60

SLLDSGDYTK ALEYVDKIVL VFSPACSTAK ILKVKSLLAT KDYSSAIAES GFILKEDENN     120

LEALLLRGRA YYYLADHDVA MRHYQKGLRL DPEHADLKKA YFGLKNLLKK TKSAEDNLNK     180

GKLRLAVEDY KGAIALDPDH HAHNVHLHLG LCKVLVKLGR GKEALTSCTD AL DIDGDLTE    240
                                 LEUCINE ZIPPER
ALVQRGEAKL LTEDWEGAVD DLKSAAQKSP QDMAIREALM RAEKALKMSK RKDWYKILGI     300

SKTASIAEIK RAYKKLALQW HPDKNVENRE EAENKFREIA AAYEVLSDEE KRTRYDRGED     360

IDEMGTGGSG GGFNPFGGGG QQFTFTFDGG FPGGFGGFQG GGFPGGFEFQ F              411
```

Figure 16

```
MEVGQMQRRL VEFTKSLFME GFLDGQFLQL QQLQDESNPD FVVEVVS LFF QDSEKLLNDL     60

TSALEQQNVD FKKVDAHVHQ LKGSSSSIGA QRVKNACVVF RSFCEEQNLE GCMRCLQQVK    120
                         Hpt domain
QEFYLAKNKF ETLFTLEQQI VAAGGSIP AM EITSF                              155
```

Figure 17

```
MDVIQLQRRF IDYTSSLYRE GFLDEQFTQL QQLQDESNPE FVAEVVS LFF EDAEKLLADL    60

SKTLAQQPID FKKVDAHVHQ FKGSSSSIGA HRVKNECISF RAFCEQRNRE GCLQCLEQLK   120
                    Hpt domain
QEYYNVKNKL ETLFQLEHQI LEAGGTIP MS E                                 151
```

Figure 18

```
MAVSQMQQRY INFTNSLFQE GFVDEQFTQL QQLQDESNPD FVAEVVF LFF EDSDKLLADL    60

SKTLNQEPVD FKRVDGCVHQ FKGSSSSIGA RRVMNTCVTF RAFCQDKNRE GCLYCLQQMK    120
                Hpt domain
QECYLVKNKL ETLFQLEKQI VEAGGTVP MA E                                  151
```

Figure 19

| KKMDAHVHQF KGSSSSVGAQ RVKNLCIALR TFCNDNNRAG CIQCLQQLKD EYYLFKDKLQ | 60 |

Hpt domain

| DLFHLEQQIL SAGGTLP MME | 80 |

Figure 20

```
MPRFHGQSNH APVDIVNQLQ KQYVDYLSSL FHEGVLDDQF TQLQKLQDE SNPDFTVEVA      60

T LFFVDSDKL INNMAAALER SPVDFKQVDA DVHQLKGSSS SIGAMRVKN LCITFRSFCET   120
      Hpt domain
QNYEGCLICL QQVKNECAVL KDKLQNLFRM EQQIVGAGGS VP LMD                  165
```

Figure 21

```
MDVAQLKRQL FEYTTLLFHE GFLDEQFTQL QQLQDENNPD FVVEVVS LFF DDSQRLLNEL    60
AKALDQQNID FKKVDAHVHQ LKGSSSSIGA QRVQRVCIAF RNYCQDKNVE GCLKCLQQVK   120
               Hpt domain
QEYSLLKNKL ETLFNLEKQI LAAGGSAP M                                   149
```

Figure 22

```
MGVLDDQFTQ LQKLQDESNP DFTVEVAT LF FVDSDKLINN MAAALERSPV DFKQVDADVH      60

QLKGSSSSIG AMRVKNLCIT FRSFCETQNY EGCLICLQQV KNECAVLKDK LQNLFRMEQQ     120
           Hpt domain
IVGAGGSVP L MD                                                        132
```

Figure 23

```
EQQNVDFKKV DAHVHQLKGS SSSIGAQRVK NACVVFRSFC EEQNLEGCMR CLQQVKQEFY    60
                          Hpt domain
LAKNKFETLF TLEQQILAAG GSIP ATEITS F                                  91
```

COMPOSITIONS ISOLATED FROM PLANT CELLS AND THEIR USE IN THE MODIFICATION OF PLANT CELL SIGNALING

CROSS-REFERENCE TO RELATED APPLICATIONS

This application is a continuation-in-part of co-pending U.S. patent application Ser. No. 09/704,302, filed Nov. 1, 2000, which is a continuation-in-part of PCT Application No. PCT/US00/00724, filed Jan. 11, 2000, which is a continuation of U.S. patent application Ser. No. 09/228,986, filed Jan. 12, 1999, now U.S. Pat. No. 6,359,198 and claims the benefit of priority to U.S. Provisional Patent Application No. 60/162,866, filed Nov. 1, 1999. The disclosures of the aforementioned applications are herein incorporated by reference in their entirety.

REFERENCE TO SEQUENCE LISTING SUBMITTED ON COMPACT DISC

This application incorporates by reference in its entirety the Sequence Listing that is provided in duplicate on compact discs that accompany the application. Each CD contains the following file: 1020C2, having a date of creation of Mar. 18, 2002 and a file size of 2.90 MB.

FIELD OF THE INVENTION

This invention relates to the field of modifying the responses of plant cells to external signals, such as environmental changes, and developmental cues. More specifically, this invention provides isolated polynucleotides encoding polypeptides that are integrally located in plant cell membranes and that mediate cellular signaling processes.

BACKGROUND OF THE INVENTION

Plants progress through set developmental programs throughout the course of their lifetimes. This is particularly evident in embryogenesis and floral development. There are a variety of signal molecules produced by certain cells in the plant to which other cells, particularly in the meristematic regions, are poised to respond. These signal molecules trigger distinct sets of developmental programs at specific times that lead to the formation of, for example, flowers or cotyledons. In addition to the programmed developmental pathways, plants are exposed to a variety of environmental stimuli such as changes in temperature and amount of sunlight, availability of water, wounding from mechanical injury and attack by pathogens. Environmental factors, such as exposure to light, heat, cold, drought, etc., activate the expression of genes and synthesis of proteins and other compounds essential for an appropriate response to the environmental signal and thereby, the healthy development of the plant. These responses, like the developmental pathways, are mediated by signal molecules (hereinafter referred to as ligands).

To respond to these ligands, plant cells produce surface receptor proteins that serve as sensors, regulators; and/or transducers of cell signals. The intracellular transduction of a signal is often transmitted via a phosphorylation cascade of molecules that culminates in the transcription of genes to elicit the appropriate cellular response either for normal development or against environmental challenge.

One major class of receptor proteins is the single-transmembrane family, of which there are several subclasses. These proteins are characterized by three domains: an extracellular signal molecule recognition/binding domain, a single cell membrane-spanning domain and an intracellular signal transduction domain which is usually a protein kinase. Many, but not all, plant single transmembrane proteins belong to the subclass known as receptor-like kinases (RLKs). The intracellular kinase domains of plant RLKs are all serine/threonine protein kinases, while the extracellular domains of RLKs are of different types. One type of RLK is characterized by the presence of the extracellular S-domain, originally described in self-incompatibility-locus glycoproteins that inhibit self-pollination. The S-domain is recognized by an array of ten cysteine residues in combination with other conserved residues. Another class of RLKs has an extracellular domain distinguished by leucine rich repeats (LRR) that are involved in protein-protein interactions. Binding of ligands to the extracellular domain is followed by receptor dimerization, autophosphorylation and the activation of a series of intracellular proteins which serve to transduce the signal to the nucleus. The structure of plant RLKs is very similar to receptors found in cell signaling pathways in animal systems.

One example of a plant RLK is the Xa21 gene, which confers resistance to the plant pathogen *Xanthomonas oryzae* pv. *oryzae* race 6. This gene was cloned using genetic means comparing Xanthomonas-sensitive and resistant strains of rice (Song et al., *Science* 270:1804–1806, 1995), and has been subsequently shown to confer resistance to Xanthomonas in Arabidopsis. The 1025 amino acid protein shows a number of features with similarity to known protein domains including a $NH_2$-terminal 23 amino acid residue signal peptide, indicating that the protein is directed to the plasma membrane. Amino acids 81 to 634 contain 23 imperfect copies of a 24-amino acid LRR. Amino acids 651 to 676 encode a 26-amino acid hydrophobic segment that is likely to form a membrane-spanning domain. The C-terminal amino acids contain a putative intracellular serine threonine kinase domain carrying 11 subdomains with all 15 invariant amino acids that are typical of protein kinases. Subdomains VI and VIII are indicative of serine-threonine phosphorylation specificity. Xa21 has strong similarities to other RLKs, such as the Arabidopsis receptor-like kinase proteins RLK5 (HAESA) and TMK1, showing conservation of both the LRR and protein kinase domains. It is not yet known to what protein Xa21 transduces its pathogen recognition signal.

Another family of membrane receptor molecules expressed by plant cells is histidine kinases (HKs). HKs have been known for some time in bacterial signal transduction systems, where they form one half of a two-component signaling system. The bacterial HK serves as a sensor molecule for extracellular signals, such as changes in osmoticum, nutrients and toxins. The HK autophosphorylates on a histidine residue in response to ligand binding. This phosphohistidine donates its phosphate group to an aspartate residue of the second member of the two component system, known as the response regulator (RR). The phosphorylated RR then goes on to further transduce the signal, by binding other proteins as regulatory subunits, thereby either activating or inactivating them, depending on the specific circumstance. Alternatively, the phosphorylated RR binds DNA in a sequence-specific manner, serving to directly activate specific genes which code for proteins that mediate the response to the extracellular stimulus. In certain cases, HKs have a composite structure. Specifically, these proteins contain RR domains at their carboxy termini. The phosphohistidine of the HK transfers its phosphoryl group to the active site aspartate residue of this RR domain. In these cases, since the RR domain is membrane-bound, the signal cannot be transduced directly by RR binding to DNA. Instead, histidine phosphotransfer (HPt) proteins serve to further transduce the signal. The phosphoaspartate of the composite HK/RR protein donates the phosphate group to an active site histidine in the HPt protein. The HPt phosphohistidine in turn donates the phosphate group to a true RR, which then modulates activities of other proteins or activates gene expression in response to the external signal.

Like bacteria, plant cells have several two-component signaling systems which consist of a sensor element HK and a RR. In addition, composite HK proteins with RR domains at their carboxy termini (hereinafter referred to as hybrid HK/RR proteins) are found in both bacteria and plants. The HK proteins are distinguished by well-conserved amino acid motifs that occur in a specific order. From the amino terminus, the conserved regions are identified as the H, N, G1, F and G2 boxes. These motifs are usually found within a 200–250 amino acid span of the protein. The G1, F and G2 boxes are thought to be involved in nucleotide binding. As in bacteria, upon receiving the extracellular ligand, the HK is autophosphorylated on the histidine residue contained in the H box. The phosphate group is subsequently transferred to the RR. Alternatively, some HKs constitutively autophosphorylate their histidine residues and this activity is suppressed by binding of the extracellular ligand. All HKs are believed to phosphorylate a RR, as an obligate part of signal transduction.

RRs are characterized by the absolute conservation of an aspartate which is phosphorylated by the phosphohistidine of the HK, and a conserved lysine residue. Unlike bacteria, RRs in plants have not been shown to bind DNA directly. Rather, all the plant RR's characterized to date appear to transduce the signal into protein kinase cascades, which eventually phosphorylate and either activate or inactivate transcription factors, and thereby gene expression. Similar to bacteria, plants also contain hybrid HK/RRs which contain a RR domain at the carboxy terminus of the protein. As might be expected based on this observation, plant genomes have also been found to harbor histidine-containing phosphotransfer (HPt) domain genes. The HPt domain has been shown to play an important role in some His-Asp phosphorelay pathways. However, it has not yet been shown directly that any plant HPt protein interacts either with a hybrid HK/RR or with a soluble RR.

The ethylene receptor family (e.g., ETR1; Chang et al., *Science* 262:539–544, 1993) comprise the best known two-component signaling system in plants. Ethylene is a well-known ligand that is involved in the coordination of fertilization, senescence, skoto/photomorphogenesis, and responses to pathogens and mechanical injury. The ethylene signal is transduced through the protein CTR1, which is a Raf-like protein kinase. CTR1 is a negative regulator of downstream steps in the signaling pathway. While the details of this pathway remain unclear, it appears that the ethylene receptors are constitutively active in the absence of ethylene, thereby constantly phosphorylating CTR1, which in turn represses other genes in the ethylene response pathway. Binding of ethylene to the ethylene receptors inhibits the phosphorylation function of the receptor, which results in the inhibition of the negative regulator CTR1, thereby allowing the activation of downstream proteins in the ethylene signal transduction cascade. This culminates in activation of ethylene response genes.

Two RR genes, IBC6 and IBC7, which are induced in response to the plant growth regulator cytokinin, have been cloned from *Arabidopsis thaliana* and characterized (Brandstatter and Kieber, *Plant Cell* 10:1009–1019, 1998). Cytokinin is known to regulate plant growth and development, including such physiological events as nutrient metabolism, expansion and senescence of leaves, and lateral branching. It is likely that IBC6 and IBC7 are involved in the transduction of the cytokinin signal in plants. Consistent with such a hypothesis, it has been demonstrated that ARR4 (IBC7) interacts directly with phytochrome B (phyB) (Sweere et al., *Science* 294:1108–1111). PhyB is one of a family of histidine kinase-like photoreceptor molecules (Thummler et al., *FEBS Lett*. 357:149–155, 1995; Kehoe and Grossman, *Science* 273:1409–1412, 1996) involved in photo/skotomorphogenesis and physiological responses to day length, such as initiation of flowering. The finding of IBC7's interaction with phyB is a link between cytokinin perception and cytokinin's physiological effects on prevention of light deprivation-mediated etiolation and senescence. Furthermore, the response regulator ARR1 has been shown to function as a transcription factor which directs the transcription of ARR6, another response regulator that is transcribed in direct response to cytokinin, like IBC6 and IBC7 (Sakai et al., *Science* 294:1519–1521, 2001). The proteins encoded by these RR genes are all possible signal transduction partners with the hybrid HK/RR known as CRE1/WOL. CRE1/WOL was recently shown to directly bind cytokinin and transduce a signal in transgenic yeast cells (Inoue et al., *Nature* 409:1060–1063, 2001; Suzuki et al., *Plant Cell Physiol*. 42:107–113, 2001). Subsequent studies have further shown that CRE1/WOL directly binds cytokinin in *Arabidopsis thaliana* (Yamada et al., *Plant Cell Physiol*. 42:1107–1123, 2001; Ueguchi et al., *Plant Cell Physiol*. 42:751–755, 2001). Furthermore, the gene encoding the hybrid HK/RR protein CKI1 causes cytokinin-like effects when it is ectopically expressed in transgenic plants (Kakimoto, *Science* 274:982–985, 1996). However, the role that the CKI1 protein plays in cytokinin signal transduction, if any, is still unclear. It is possible that any or all of the known plant response regulators may also interact with CKI1 to mediate other aspects of the cytokinin response. However, it is clear that a two-component HK/RR system is involved in cytokinin signal transduction.

While polynucleotides encoding proteins involved in plant cell signaling have been isolated for certain species of plants, genes encoding many such proteins have not yet been identified in a wide range of plant species. Thus, there remains a need in the art for materials which may be usefully employed in the modification of cell signaling in plants.

SUMMARY OF THE INVENTION

Briefly, the present invention provides polynucleotides isolated from eucalyptus and pine which encode polypeptides involved in cell signaling, together with methods for the use of such polynucleotides and polypeptides. Such polypeptides function as sensor-regulators or receptor kinases. The isolated polynucleotides and polypeptides may be usefully employed in the modification of plant cell responses either during the growth and development of a plant, or under conditions of stress resulting from pathogens or environmental factors.

In a first aspect, the present invention provides isolated and purified polynucleotides obtainable from eucalyptus and pine which encode RLKs, HKs, RRs, HPts or hybrid HK/RR proteins. In one embodiment, the isolated polynucleotides comprise a DNA sequence selected from the group consisting of: (a) sequences recited in SEQ ID NO: 1–67, 131–481, 833–888, 946–952 and 960–974; (b) complements of the sequences recited in SEQ ID NO: 1–67, 131–481, 833–888, 946–952 and 960–974; (c) reverse complements of the sequences recited in SEQ ID NO: 1–67, 131–481, 833–888, 946–952 and 960–974; (d) reverse sequences of the sequences recited in SEQ ID NO: 1–67, 131–481, 833–888, 946–952 and 960–974; and (e) sequences having either 75%, 90% or 95% identity, as defined herein, to a sequence of (a)–(d).

In a further aspect, isolated polypeptides encoded by an inventive polynucleotide are provided. In certain embodiments, such polypeptides comprise an amino acid sequence selected from the group consisting of SEQ ID NO: 68–130, 482–832, 889–945, 953–959 and 975–989; and sequences having at least 75%, 90% or 95% identity to a sequence of SEQ ID NO: 68–130, 482–832, 889–945, 953–959 and 975–989.

In another aspect, the invention provides genetic constructs comprising a polynucleotide of the present invention, either alone, in combination with one or more other polynucleotides disclosed herein, or in combination with one or more known DNA sequences, together with transgenic cells comprising such constructs.

In a related aspect, the present invention provides genetic constructs comprising, in the 5'–3' direction, a gene promoter sequence; an open reading frame coding for at least a functional portion of a polypeptide of the present invention; and a gene termination sequence. The open reading frame may be orientated in either a sense or antisense direction. Genetic constructs comprising an untranslated, or non-coding, region of a gene coding for an inventive polypeptide or a nucleotide sequence complementary to a non-coding region, together with a gene promoter sequence and a gene termination sequence, are also provided. Preferably, the gene promoter and termination sequences are functional in a host plant. Most preferably, the gene promoter and termination sequences are those of the original genes but others generally used in the art, such as the Cauliflower Mosaic Virus (CaMV) promoter, with or without enhancers such as the Kozak sequence or Omega enhancer, and *Agrobacterium tumefaciens* nopaline synthase terminator may be usefully employed in the present invention. Tissue-specific promoters may be employed in order to target expression to one or more desired tissues. The genetic construct may further include a marker for the identification of transformed cells.

In a further aspect, transgenic cells, preferably plant cells, comprising the genetic constructs of the present invention are provided, together with organisms, preferably plants, comprising such transgenic cells, and fruit and seeds and other products, derivatives, or progeny of such plants. Propagules of such transgenic plants are also encompassed in the present invention. As used herein, the word "propagule" means any part of a plant that may be used in reproduction or propagation, sexual or asexual, including cuttings In yet another aspect, methods for modifying cell signaling in a target organism, such as a plant, are provided, such methods including stably incorporating into the genome of the plant a genetic construct of the present invention. In a preferred embodiment, the target plant is a woody plant, preferably selected from the group consisting of eucalyptus and pine species, most preferably from the group consisting of *Eucalyptus grandis* and *Pinus radiata*. In a related aspect, a method for producing a target organism, such as a plant, having modified cell signaling is provided, the method comprising transforming a plant cell with a genetic construct of the present invention to provide a transgenic cell and cultivating the transgenic cell under conditions conducive to regeneration and mature plant growth.

In yet a further aspect, the present invention provides methods for modifying the activity of a polypeptide in a target organism, such as a plant, comprising stably incorporating a genetic construct of the present invention into the genome of the plant. In a preferred embodiment, the target plant is a woody plant, preferably selected from the group consisting of eucalyptus and pine species, most preferably from the group consisting of *Eucalyptus grandis* and *Pinus radiata*.

The above-mentioned and additional features of the present invention and the manner of obtaining them will become apparent, and the invention will be best understood by reference to the drawings and the following more detailed description. All references disclosed herein are hereby incorporated by reference in their entirety as if each was incorporated individually.

BRIEF DESCRIPTION OF THE DRAWINGS

FIG. 1A shows the amino acid sequence of SEQ ID NO: 76, with the signal sequence and transmembrane domain being underlined. In the extracellular domain, twelve leucine-rich repeats (boxed) are flanked by two pairs of conservatively spaced cysteines (in bold). In the leucine-rich repeat region, a conserved sequence characteristic of the kinase family has been identified. The alignment of the leucine-rich repeats with this conserved element is shown in FIG. 1B. The intracellular domain is characterized by the eleven conserved protein kinase domains (Hanks and Quinn, *Methods Enzymol.* 200:38–62, 1991) marked with Roman numerals. The fifteen residues invariant in protein kinases and the conserved cysteine residue are in bold.

FIG. 1B shows the alignment of leucine-rich repeats in the extracellular domain of SEQ ID NO: 76. The numbers to the right of the alignment indicate the number of leucine-rich repeats. A six-amino acid signature inserted in LRR5 is characteristic of this family of receptor-like kinases. The consensus sequence shown below the alignment is commonly found in other plant proteins containing LRRs (Li and Chory, *Cell* 90:929–938, 1997).

FIG. 2 illustrates the amino acid sequence of SEQ ID NO: 114, showing a signal peptide and three transmembrane domains. Other conserved boxes characteristic of hybrid HK/RR proteins were also identified (boxed): an H-box, N-box, G1-box, F-box, G2-box, DD-box, D-box and KP-box (Grebe and Stock, *Adv. Microb. Physiol.* 41:139–227, 1999).

FIG. 3 illustrates the amino acid sequence of SEQ ID NO: 906, showing the following conserved boxes characteristic of hybrid HK/RR proteins (boxed): an H-box, N-box, G1-box, F-box, G2-box, DD-box, D-box and KP-box (Grebe and Stock, *Adv. Microb. Physiol.* 41:139–227, 1999).

FIG. 4 illustrates the amino acid sequence of SEQ ID NO: 908, showing the Hpt domain (Grebe and Stock, *Adv. Microb. Physiol.* 41:139–227, 1999).

FIG. 5 illustrates the amino acid sequence of SEQ ID NO: 909, showing the following conserved boxes characteristic of hybrid HK/RR proteins (boxed): an H-box, N-box, G1-box, F-box, G2-box, DD-box, D-box and KP-box (Grebe and Stock, *Adv. Microb. Physiol.* 41:139–227, 1999).

FIG. 6 illustrates the amino acid sequence of SEQ ID NO: 975, showing the following conserved boxes characteristic of RRs (boxed): an DD-box, D-box and KP-box (Grebe and Stock, *Adv. Microb. Physiol.* 41:139–227, 1999).

FIG. 7 illustrates the amino acid sequence of SEQ ID NO: 956, showing a signal peptide and two transmembrane domains. The following conserved boxes characteristic of HK/RR proteins (boxed) were identified: an H-box, N-box, G1-box, F-box, G2-box, DD-box, D-box and KP-box (Grebe and Stock, *Adv. Microb. Physiol.* 41:139–227, 1999).

FIG. 8 illustrates the amino acid sequence of SEQ ID NO: 957, showing two transmembrane domains. The following conserved boxes characteristic of hybrid HK/RR proteins (boxed) were identified: an H-box, N-box, G1-box, F-box, G2-box, DD-box, D-box and KP-box (Grebe and Stock, *Adv. Microb. Physiol.* 41:139–227, 1999).

FIG. 9 illustrates the amino acid sequence of SEQ ID NO: 976, showing two transmembrane domains. The following conserved boxes characteristic of hybrid HK/RR proteins (boxed) were identified: an H-box, N-box, G1-box, F-box, G2-box, DD-box, D-box and KP-box (Grebe and Stock, *Adv. Microb. Physiol.* 41:139–227, 1999).

FIG. 10A illustrates the nucleotide sequence of SEQ ID NO: 961, encoding a histidine kinase. In a splice variant of SEQ ID NO: 961 (SEQ ID NO: 962; shown in FIG. 11A), the nucleotides in bold and underlined are spliced out to produce a shorter variant of the protein. The amino acid sequence encoded by SEQ ID NO: 961 (SEQ ID NO: 977) is given in FIG. 10B, and the amino acid sequence of the splice variant (SEQ ID NO: 978) is given in FIG. 11B.

FIG. 10B illustrates the amino acid sequence of SEQ ID NO: 977, showing two transmembrane domains. The following conserved boxes characteristic of hybrid HK/RR proteins (boxed) were identified: an H-box, N-box, G1-box, F-box, G2-box, DD-box, D-box and KP-box (Grebe and Stock, *Adv. Microb. Physiol.* 41:139–227, 1999).

FIG. 11A illustrates the nucleotide sequence of SEQ ID NO: 962, encoding a splice variant of the histidine kinase given in SEQ ID NO: 961 (FIG. 10A). The amino acid sequence encoded by the splice variant (SEQ ID NO: 978) is given in FIG. 11B.

FIG. 11B illustrates the amino acid sequence of SEQ ID NO: 978, which is a splice variant of SEQ ID NO: 977. Two transmembrane domains (underlined) and a conserved boxe H-box (boxed) (Grebe and Stock, *Adv. Microb. Physiol.* 41:139–227, 1999) are present in this variant.

FIG. 12 illustrates the amino acid sequence of SEQ ID NO: 979, showing two transmembrane domains. The following conserved boxes characteristic of hybrid HK/RR proteins (boxed) were identified: an H-box, N-box, G1-box, F-box, G2-box, DD-box, D-box and KP-box (Grebe and Stock, *Adv. Microb. Physiol.* 41:139–227, 1999).

FIG. 13 illustrates the amino acid sequence of SEQ ID NO: 980, showing the following conserved boxes characteristic of RRs (boxed): a DD-box, D-box and KP-box (Grebe and Stock, *Adv. Microb. Physiol.* 41:139–227, 1999).

FIG. 14 illustrates the amino acid sequence of SEQ ID NO: 981, showing the following conserved boxes characteristic of histidine kinases (boxed): an H-box, N-box and G1-box (Grebe and Stock, *Adv. Microb. Physiol.* 41:139–227, 1999).

FIG. 15 illustrates the amino acid sequence of SEQ ID NO: 982, showing a leucine zipper (underlined).

FIG. 16 illustrates the amino acid sequence of SEQ ID NO: 854, showing a conserved Hpt domain (boxed) (Grebe and Stock, *Adv. Microb. Physiol.* 41:139–227, 1999).

FIG. 17 illustrates the amino acid sequence of SEQ ID NO: 983, showing a conserved Hpt domain (boxed) (Grebe and Stock, *Adv. Microb. Physiol.* 41:139–227, 1999).

FIG. 18 illustrates the amino acid sequence of SEQ ID NO: 984, showing a conserved Hpt domain (boxed) (Grebe and Stock, *Adv. Microb. Physiol.* 41:139–227, 1999).

FIG. 19 illustrates the amino acid sequence of SEQ ID NO: 985, showing a conserved Hpt domain (boxed) (Grebe and Stock, *Adv. Microb. Physiol.* 41:139–227, 1999).

FIG. 20 illustrates the amino acid sequence of SEQ ID NO: 986, showing a conserved Hpt domain (boxed) (Grebe and Stock, *Adv. Microb. Physiol.* 41:139–227, 1999).

FIG. 21 illustrates the amino acid sequence of SEQ ID NO: 987, showing a conserved Hpt domain (boxed) (Grebe and Stock, *Adv. Microb. Physiol.* 41:139–227, 1999).

FIG. 22 illustrates the amino acid sequence of SEQ ID NO: 988, showing a conserved Hpt domain (boxed) (Grebe and Stock, *Adv. Microb. Physiol.* 41:139–227, 1999).

FIG. 23 illustrates the amino acid sequence of SEQ ID NO: 989, showing a conserved Hpt domain (boxed) (Grebe and Stock, *Adv. Microb. Physiol.* 41:139–227, 1999).

DETAILED DESCRIPTION

The present invention provides isolated and purified polynucleotides that encode polypeptides involved in plant cell signaling. As discussed above, cell signaling is known to play a critical role in the growth and development of plants, and in cellular responses to external stimuli, such as environmental factors and pathogens. Transformation of plants with polynucleotides that encode polypeptides involved in cell signaling may thus be employed to modify properties such as cell proliferation, differentiation, elongation and survival; resistance to disease; and nutrient metabolism.

As discussed above, histidine kinases (HKs) play important roles in signal transduction systems in microbial organisms and eukaryotes (e.g. plants and yeast), and have well-established uses due to their enzymatic activity—namely the autophosphorylation of an H box histidine residue and donation of the phosphoryl group to a specific aspartate residue in a response regulator. For example, the hybrid HK/RR ETR1 is known to be involved in ethylene signal transduction. Modulation of ETR1 expression will thus lead to a modification of physiological properties regulated by ethylene, such as fruit ripening, and senescence of leaves and flowers. Modulation of the expression of this protein in transgenic plants may therefore be employed to prolong the useful life of cut flowers by delaying senescence. Additionally, modulation of the expression of ETR1 may be used to selectively enhance the senescence of reproductive organs, resulting in engineered sterile plants. Over-expression of the ethylene receptor ligand-binding domain can be used to engineer an ethylene-insensitive phenotype.

Osmosensor histidine kinases participate in signal transduction in bacteria, yeast and plants. For example, genetic constructs containing domains of osmosensor polypeptides encoded by the inventive polynucleotides can be introduced into plants and expressed to create plants that are tolerant to drought or saline.

The hybrid BK/RR protein CRE1 is involved in cytokinin signal transduction. Cytokinin has been shown to play critical roles in lateral branching, leaf expansion, cell division, nutrient distribution and delaying senescence, among other physiological and developmental phenomena. Therefore, modulation of the expression of CRE1 may result in, for example, the delay of senescence in selected cell types or organs. This would result in prolonged shelf life for fruits and vegetables between harvest and consumption. Alternatively, modulation of CRE1 expression may be used to decrease branching frequency in forest tree species, resulting in long stretches of valuable knot-free clearwood for use in solid timber furniture and veneers.

Using the methods and materials of the present invention, the amount of a specific plant cell polypeptide may be modulated by incorporating additional copies of genes encoding the polypeptide into the genome of a target organism, such as a plant. Similarly, an increase or decrease in the amount of the polypeptide may be obtained by transforming the target organism with antisense copies or RNAi expression constructs of such genes. Ligand binding domains of, for example, histidine kinases may be used as "dominant negatives" to bind ligand without transducing signal, thereby preventing or reducing signal transduction. Alternatively, the kinase domain alone may be used as a "dominant positive" to transduce signal in the absence of ligand.

In one embodiment, the present invention provides isolated polynucleotides encoding, or partially encoding, plant polypeptides that are involved in cell signaling, the polynucleotides being derived from eucalyptus and pine. Specifically, the present invention provides isolated polynucleotides encoding RLKs from *Eucalyptus grandis* (SEQ ID NO: 2, 8, 9, 11, 15, 18, 19, 21–25, 33, 34, 38, 131–301, 448–463, 848, 858–874, 882–887, 946 and 947) and *Pinus radiata* (SEQ ID NO: 1, 3–7, 10, 12–14, 16, 17, 20, 26–32, 35–37, 39–41, 302–447, 833–847, 875–881 and 888), and isolated polynucleotides encoding at least one member of a two-component signaling system (HKs, RRs or hybrid HK/RR proteins) from *Eucalyptus grandis* (SEQ ID NO: 42, 48–52, 55–58, 67, 464–471, 474–478, 850–857, 948–952, 960–967 and 971–974) and *Pinus radiata* (SEQ ID NO: 43–47, 53, 54, 59–66, 472, 473, 479–481, 849 and 968–970). Complements of such isolated polynucleotides, reverse complements of such isolated polynucleotides and reverse sequences of such isolated polynucleotides are also provided, together with variants of such sequences, as defined below.

In another embodiment, the present invention provides isolated polypeptides encoded by the inventive polynucleotides. The amino acid sequences encoded by the DNA sequences of SEQ ID NO: 1–59, 63, 64, 66, 67, 131–481, 833–848, 851, 853–888, 946–952, 960–966 and 968–974 are provided in SEQ ID NO: 68–130, 482–832, 889–945, 953–959, 976–982 and 983–989, respectively. The amino acid sequence of SEQ ID NO: 975 is an extended sequence of SEQ ID NO: 910. Thus, in certain embodiments, the inventive polypeptides comprise amino acid sequences selected from the group consisting of 68–130, 482–832, 889–945, 953–959 and 975–989, and variants thereof.

The locations of open reading frames (ORFs) within the inventive polynucleotide sequences, together with the SEQ ID NO: for the corresponding amino acid sequence, are identified below in Table 1.

TABLE 1

| SEQ ID NO: Polynucleotide | ORF region | SEQ ID NO: Polypeptide |
|---|---|---|
| 1 | 134–2134 | 68 |
| 2 | 7–2079 | 69 |
| 3 | 465–2432 | 70 |
| 4 | 237–2129 | 71 |
| 5 | 11–2743 | 72 |
| 6 | 98–2941 | 73 |
| 7 | 164–2080 | 74 |

TABLE 1-continued

| SEQ ID NO: Polynucleotide | ORF region | SEQ ID NO: Polypeptide |
|---|---|---|
| 8 | 139–2118 | 75 |
| 9 | 163–3069 | 76 |
| 10 | 13–1911 | 77 |
| 11 | 144–2855 | 78 |
| 12 | 58–2193 | 79 |
| 13 | 57–2180 | 80 |
| 47 | 880–3168 | 114 |
| 262 | 52–1629 | 613 |
| 456 | 1141–3102 | 807 |
| 457 | 73–2055 | 808 |
| 458 | 49–3477 | 809 |
| 459 | 383–2536 | 810 |
| 460 | 203–2104 | 811 |
| 461 | 108–1979 | 812 |
| 462 | 80–1918 | 813 |
| 463 | 224–3196 | 814 |
| 833 | 223–3213 | 889 |
| 834 | 57–2474 | 890 |
| 835 | 64–2097 | 891 |
| 836 | 70–1101 | 892 |
| 837 | 19–1572 | 893 |
| 839 | 2–2998 | 895 |
| 840 | 26–2620 | 896 |
| 841 | 59–2149 | 897 |
| 844 | 62–3562 | 900 |
| 848 | 72–1871 | 904 |
| 854 | 74–541 | 907 |
| 855 | 254–628 | 908 |
| 856 | 314–3370 | 909 |
| 858 | 183–3011 | 911 |
| 859 | 11–2413 | 912 |
| 860 | 83–1708 | 913 |
| 861 | 5–3001 | 914 |
| 862 | 5–2488 | 915 |
| 863 | 261–2162 | 916 |
| 864 | 35–1921 | 917 |
| 865 | 249–2306 | 918 |
| 868 | 43–3204 | 921 |
| 869 | 143–2620 | 922 |
| 870 | 111–2582 | 923 |
| 871 | 61–2208 | 924 |
| 872 | 38–1873 | 925 |
| 873 | 83–2479 | 926 |
| 874 | 154–2043 | 927 |
| 878 | 145–1515 | 931 |
| 879 | 198–2105 | 932 |
| 880 | 354–3344 | 933 |
| 881 | 70–2556 | 934 |
| 946 | 143–2143 | 953 |
| 947 | 60–3122 | 954 |
| 949 | 61–3195 | 956 |
| 950 | 374–3382 | 957 |
| 857 | 1–777 | 975 |
| 960 | 96–3818 | 976 |
| 961 | 553–3546 | 977 |
| 962 | 553–195 | 978 |
| 963 | 427–4239 | 979 |
| 964 | 359–1033 | 980 |
| 965 | 149–685 | 981 |
| 966 | 2–1237 | 982 |
| 968 | 144–599 | 983 |
| 969 | 95–550 | 984 |
| 970 | 2–244 | 985 |
| 971 | 203–697 | 986 |
| 972 | 36–485 | 987 |
| 973 | 38–433 | 988 |
| 974 | 520–792 | 989 |

The polynucleotides disclosed herein were derived from forestry plant sources, namely *Eucalyptus grandis* and *Pinus radiata*. Some of the polynucleotides of the present invention are "partial" sequences, in that they do not represent a full-length gene encoding a full-length polypeptide. The term "polypeptide encoded by a polynucleotide" as used herein, includes polypeptides encoded by a nucleotide sequence that includes partial isolated DNA sequences of the present invention. Such partial sequences may be extended by analyzing and sequencing various DNA libraries using primers and/or probes and well known hybridization and/or PCR techniques. Partial sequences may be extended until an open reading frame encoding a polypeptide, a full-length polynucleotide and/or gene capable of expressing a polypeptide, or another useful portion of the genome is identified. Such extended sequences, including full-length polynucleotides and genes, are described as "corresponding to" a sequence disclosed herein, or a variant thereof, or a portion of one of the sequences disclosed herein, or a variant thereof, when the extended polynucleotide comprises an identified sequence or its variant, or an identified contiguous portion (x-mer) of one of the sequences disclosed herein, or a variant thereof. Similarly, RNA sequences, reverse sequences, complementary sequences, antisense sequences, and the like, corresponding to the polynucleotides of the present invention, may be routinely ascertained and obtained using the cDNA sequences identified as SEQ ID NOS: 1–67, 131–481, 833–888, 946—952 and 960–974.

As discussed above, the polynucleotides disclosed herein may contain open reading frames (ORFs) or partial ORFs encoding polypeptides. Additionally ORFs encoding polypeptides may be identified in extended or full-length sequences corresponding to the polynucleotide sequences disclosed herein. ORFs may be identified using techniques that are well known in the art. These techniques include, for example, analysis for the location of known start and stop codons, most likely reading frame identification based on codon frequencies, etc. Suitable tools and software for ORF analysis are available, for example, on the Internet at the National Institutes of Health NCBI website. ORFs and portions of ORFs may be identified in the polynucleotides of the present invention. Once a partial open reading frame is identified, the polynucleotide may be extended in the area of the partial open reading frame using techniques that are well known in the art until the polynucleotide for the full open reading frame is identified. Thus, ORFs encoding polypeptides may be identified using the polynucleotides of the present invention.

Once ORFs are identified in the polynucleotides of the present invention, the ORFs may be isolated and/or synthesized. Expressible genetic constructs comprising the ORFs and suitable promoters, initiators, terminators, etc., which are well known in the art, may then be constructed. Such genetic constructs may be introduced into a host cell to express the polypeptide encoded by the open reading frame. Suitable host cells may include various prokaryotic and eukaryotic cells, including plant cells, mammalian cells, bacterial cells, algae and the like.

Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

The term "polynucleotide(s)," as used herein, means a single or double-stranded polymer of deoxyribonucleotide or ribonucleotide bases and includes DNA and corresponding RNA molecules, including hnRNA and mRNA molecules, both sense and anti-sense strands, and comprehends cDNA, genomic DNA and recombinant DNA, as well as wholly or partially synthesized polynucleotides. An hnRNA molecule contains introns and corresponds to a DNA molecule in a generally one-to-one manner. An mRNA molecule corresponds to an hnRNA and DNA molecule from which the introns have been excised. A polynucleotide may consist of an entire gene, or any portion thereof. Operable anti-sense polynucleotides may comprise a fragment of the corresponding polynucleotide, and the definition of "polynucleotide" therefore includes all such operable anti-sense fragments. Anti-sense polynucleotides and techniques involving anti-sense polynucleotides are well known in the art and are described, for example, in Robinson-Benion et al., *Methods in Enzymol.* 254: 363–375, 1995; and Kawasaki et al., *Artfic. Organs* 20: 836–848, 1996.

The term "polypeptide", as used herein, encompasses amino acid chains of any length including full length proteins, wherein amino acid residues are linked by covalent peptide bonds. Polypeptides of the present invention may be purified natural products, or may be produced partially or wholly using recombinant or synthetic techniques. Polypeptides of the present invention may be purified natural products, or may be produced partially or wholly using recombinant techniques. Polypeptides described herein may be produced using recombinant DNA methodologies, specifically, by inserting a DNA sequence that encodes the polypeptide into an expression vector and producing the polypeptide in an appropriate host. Any of a variety of expression vectors known to those of ordinary skill in the art may be employed. Expression may be achieved in any appropriate host cell that has been transformed or transfected with an expression vector containing a polynucleotide that encodes a recombinant polypeptide. The DNA sequences expressed in this manner may encode naturally occurring polypeptides, portions of naturally occurring polypeptides, or other variants thereof.

In general, the polynucleotides and polypeptides disclosed herein are prepared in an isolated, substantially pure, form. Preferably, the polynucleotides and polypeptides are at least about 80% pure, more preferably at least about 90% pure, and most preferably at least 99% pure.

The definition of the terms "complement", "reverse complement" and "reverse sequence", as used herein, is best illustrated by the following example. For the sequence 5' AGGACC 3', the complement, reverse complement and reverse sequence are as follows:

| complement | 3' TCCTGG 5' |
| reverse complement | 3' GGTCCT 5' |
| reverse sequence | 5' CCAGGA 3'. |

As used herein, the term "variant" comprehends nucleotide or amino acid sequences different from the specifically identified sequences, wherein one or more nucleotides or amino acid residues is deleted, substituted, or added. Variants may be naturally occurring allelic variants, or non-naturally occurring variants. In certain embodiments, variants of the inventive sequences retain certain, or all, of the functional characteristics of the inventive sequence. In preferred embodiments, variants of the inventive polynucleotides encode polypeptides that are involved in a cell signaling pathway. Variant sequences (polynucleotide or polypeptide) preferably exhibit at least 50%, more preferably at least 75%, more preferably yet at least 90%, and most preferably 95% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100.

Polynucleotide or polypeptide sequences may be aligned, and percentages of identical nucleotides in a specified region may be determined against another polynucleotide or polypeptide, using computer algorithms that are publicly available. Two exemplary algorithms for aligning and identifying the similarity of polynucleotide sequences are the BLASTN and FASTA algorithms. The alignment and similarity of polypeptide sequences may be examined using the BLASTP algorithm. BLASTX and FASTX algorithms compare nucleotide query sequences translated in all reading frames against polypeptide sequences. The BLASTN, BLASTP and BLASTX algorithms are available on the NCBI anonymous FTP server and are available from the National Center for Biotechnology Information (NCBI), National Library of Medicine, Building 38A, Room 8N805, Bethesda, Md. 20894 USA.

The FASTA and FASTX algorithms are available on the Internet. The FASTA software package is also available from the University of Virginia by contacting the Assistant Provost for Research, University of Virginia, PO Box 9025, Charlottesville, Va. 22906-9025. The FASTA algorithm, set to the default parameters described in the documentation and distributed with the algorithm, may be used in the determination of polynucleotide variants. The readme files for FASTA and FASTX v1.0x that are distributed with the algorithms describe the use of the algorithms and describe the default parameters. The use of the FASTA and FASTX algorithms is also described in Pearson, and Lipman, *Proc. Natl. Acad. Sci. USA* 85:2444–2448, 1988; and Pearson, *Methods in Enzymol.* 183:63–98, 1990.

The BLASTN algorithm version 2.0.4 [Feb. 24, 1998], 2.0.6 [Sep. 16, 1998] and 2.0.11 [Jan. 20, 2000], set to the default parameters described in the documentation and distributed with the algorithm, is preferred for use in the determination of polynucleotide variants according to the present invention. The BLASTP algorithm version 2.0.4, 2.0.6 and 2.0.11, set to the default parameters described in the documentation and distributed with the algorithm, is preferred for use in the determination of polypeptide variants according to the present invention. The use of the BLAST family of algorithms, including BLASTN, BLASTP and BLASTX is described in the publication of Altschul et al., *Nucleic Acids Res.* 25:3389–3402, 1997.

The following running parameters are preferred for determination of alignments and similarities using BLASTN that contribute to the E values and percentage identity for polynucleotides: Unix running command with default parameters thus: blastall -p blastn -d embldb -e 10 -G 0 -E 0 -r 1 -v 30 -b 30 -i queryseq -o results; and parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (blastn only) [Integer]; -v Number of one-line descriptions (V) [Integer]; -b Number of alignments to show (B) [Integer]; -i Query File [File In]; -o BLAST report Output File [File Out] Optional. The following running parameters are preferred for determination of alignments and similarities using BLASTP that contribute to the E values and percentage identity for polypeptides: blastall -p blastp d swissprotdb -e 10 -G 0 -B 0 -v 30 -b 30 -i queryseq -o results; and the parameters are:: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional.

The "hits" to one or more database sequences by a queried sequence produced by BLASTN, BLASTP, FASTA, or a similar algorithm, align and identify similar portions of sequences. The hits are arranged in order of the degree of similarity and the length of sequence overlap. Hits to a database sequence generally represent an overlap over only a fraction of the sequence length of the queried sequence.

As noted above, the percentage identity of a polynucleotide or polypeptide sequence is determined by aligning polynucleotide and polypeptide sequences using appropriate algorithms, such as; BLASTN or BLASTP, respectively, set to default parameters; identifying the number of identical nucleic or amino acids over the aligned portions; dividing the number of identical nucleic or amino acids by the total number of nucleic or amino acids of the polynucleotide or polypeptide of the present invention; and then multiplying by 100 to determine the percentage identity. By way of example, a queried polynucleotide having 220 nucleic acids has a hit to a polynucleotide sequence in the EMBL database having 520 nucleic acids over a stretch of 23 nucleotides in the alignment produced by the BLASTN algorithm using the default parameters. The 23 nucleotide hit includes 21 identical nucleotides, one gap and one different nucleotide. The percentage identity of the queried polynucleotide to the hit in the EMBL database is thus 21/220 times 100, or 9.5%. The identity of polypeptide sequences may be determined in a similar fashion.

The BLASTN and BLASTX algorithms also produce "Expect" values for polynucleotide and polypeptide alignments. The Expect value (E) indicates the number of hits one can "expect" to see over a certain number of contiguous sequences by chance when searching a database of a certain size. The Expect value is used as a significance threshold for determining whether the hit to a database indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the sequences then have a probability of 90% of being the same. For sequences having an E value of 0.01 or less over aligned and matched portions, the probability of finding a match by chance in the EMBL database is 1% or less using the BLASTN algorithm. E values for polypeptide sequences may be determined in a similar fashion using various polypeptide databases, such as the SwissProt database.

According to one embodiment, "variant" polynucleotides and polypeptides, with reference to each of the polynucleotides and polypeptides disclosed herein, preferably comprise sequences having the same number or fewer nucleic or amino acids than each of the polynucleotides or polypeptides of the present invention and producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN or BLASTX algorithms set at the default parameters. According to a preferred embodiment, a variant polynucleotide is a sequence having the same number or fewer nucleic acids than a polynucleotide of the present invention that has at least a 99% probability of being the same as the polynucleotide of the present invention, measured as having an E value of 0.01 or less using the BLASTN algorithm set at the default parameters. Similarly, according to a preferred embodiment, a variant polypeptide is a sequence having the same number or fewer amino acids than a polypeptide of the present invention that has at least a 99% probability of being the same as the polypeptide of the present invention, measured as having an E value of 0.01 or less using the BLASTP algorithm set at the default parameters.

Variant polynucleotide sequences will generally hybridize to the recited polynucleotide sequences under stringent conditions. As used herein, "stringent conditions" refers to prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1% SDS at 65° C.

The present invention also encompasses polynucleotides that differ from the disclosed sequences but that, as a consequence of the degeneracy of the genetic code, encode a polypeptide which is the same as that encoded by a polynucleotide disclosed herein. Additionally, polynucleotides comprising sequences that differ from the polynucleotide sequences disclosed herein as a result of deletions and/or insertions totaling less than 10% of the total sequence length are also contemplated by and encompassed within the present invention. Similarly, polypeptides comprising sequences that differ from the polypeptide sequences disclosed herein, as a result of amino acid substitutions, insertions, and/or deletions totaling less than 10% of the total sequence length are contemplated by and encompassed within the present invention.

As used herein, the term "x-mer," with reference to a specific value of "x," refers to a polynucleotide comprising at least a specified number ("x") of contiguous residues of any of the polynucleotides identified as SEQ ID NO: 1–67, 131–481, 833–888, 946–952 and 960–974. The value of x may be from about 20 to about 600, depending upon the specific sequence.

Polynucleotides of the present invention comprehend polynucleotides comprising at least a specified number of contiguous residues (x-mers) of any of the polynucleotides identified as SEQ ID NO: 1–67, 131–481, 833–888, 946–952 and 960–974 or their variants. According to preferred embodiments, the value of x is preferably at least 20, more preferably at least 40, more preferably yet at least 60, and most preferably at least 80. Thus, polynucleotides of the present invention include polynucleotides comprising a 20-mer, a 40-mer, a 60-mer, an 80-mer, a 100-mer, a 120-mer, a 150-mer, a 180-mer, a 220-mer a 250-mer, a 300-mer, a 400-mer, a 500-mer or a 600-mer of a polynucleotide identified as SEQ ID NO: 1–67, 131–481, 833–888, 946–952 and 960–974, or of a variant of one of the polynucleotides identified as SEQ ID NO: 1–67, 131–481, 833–888, 946–952 and 960–974.

The inventive polynucleotides may be isolated by high throughput sequencing of cDNA libraries prepared from *Eucalyptus grandis* and *Pinus radiata* as described below in Examples 1 and 2. Alternatively, oligonucleotide probes based on the sequences provided in SEQ ID NO: 1–67, 131–481, 833–888, 946–952 and 960–974 can be synthesized and used to identify positive clones in either cDNA or genomic DNA libraries from *Eucalyptus grandis* and *Pinus radiata* by means of hybridization or PCR techniques. Probes can be shorter than the sequences provided herein but should be at least about 10, preferably at least about 15 and most preferably at least about 20 nucleotides in length. Hybridization and PCR techniques suitable for use with such oligonucleotide probes are well known in the art, and include those taught by Sambrook et al., *Molecular cloning: a laboratory manual*, Cold Spring Harbor Laboratory Press, Cold Spring Harbor, N.Y., 1989. Positive clones may be analyzed by restriction enzyme digestion, DNA sequencing or the like.

In addition, the DNA sequences of the present invention may be generated by synthetic means using techniques well known in the art. Equipment for automated synthesis of oligonucleotides is commercially available from suppliers such as Perkin Elmer/Applied Biosystems Division (Foster City, Calif.) and may be operated according to the manufacturer's instructions.

In one embodiment, the genetic constructs of the present invention include an open reading frame coding for at least a functional portion of a polypeptide encoded by a polynucleotide of the present invention or a variant thereof. As used herein, the "functional portion" of a polypeptide is that portion which contains the binding site and/or the catalytic signal transduction site of the polypeptide. Examples of functional portions of the inventive polypeptides include the domains identified in FIGS. 1–23. The functional portion can be determined by targeted mutagenesis and screening of modified polypeptide products with protocols well known in the art. Normally, the functional portion is 10–20 amino acids in length, but can be shorter or longer. The active site may be made up of separate portions present on one or more polypeptide chains and will generally exhibit high substrate specificity.

The open reading frame is inserted in the genetic construct in a sense or antisense orientation, such that transformation of a target plant with the genetic construct will lead to a change in the amount of polypeptide compared to the wild-type plant. Transformation with a genetic construct comprising an open reading frame in a sense orientation will generally result in over-expression of the selected gene, while transformation with a genetic construct comprising an open reading frame in an antisense orientation will generally result in reduced expression of the selected gene. A population of plants transformed with a genetic construct comprising an open reading frame of the present invention in either a sense or antisense orientation may be screened for increased or reduced expression of the gene in question using techniques well known to those of skill in the art, and plants having the desired phenotypes may thus be isolated.

Alternatively, expression of a gene involved in plant cell signaling may be inhibited by inserting a portion of an open reading frame of the present invention, in either sense or antisense orientation, in the genetic construct. Such portions need not be full-length but preferably comprise at least 25 and more preferably at least 50 residues of an inventive polynucleotide. However, a longer portion or even the full-length DNA corresponding to the complete open reading frame may be employed. The portion of the open reading frame does not need to be precisely the same as the endogenous sequence, provided that there is sufficient sequence similarity to achieve inhibition of the target gene. Thus a sequence derived from one species may be used to inhibit expression of a gene in a different species.

In a second embodiment, the inventive genetic constructs comprise a DNA sequence including an non-coding region of a gene coding for a polypeptide of the present invention, or a DNA sequence complementary to such an non-coding region. Examples of non-coding regions which may be usefully employed in such constructs include introns and 5'-untranslated leader sequences. Transformation of a target plant with such a genetic construct may lead to a reduction in the amount of the polypeptide expressed in the plant by the process of cosuppression, in a manner similar to that discussed, for example, by Napoli et al., *Plant Cell* 2:279–290, 1990, and de Carvalho Niebel et al., *Plant Cell* 7:347–358, 1995.

Alternatively, regulation of polypeptide expression can be achieved by inserting appropriate sequences or subsequences (e.g. DNA or RNA) in ribozyme constructs (McIntyre and Manners, *Transgenic Res.* 5(4): 257–262, 1996). Ribozymes are synthetic RNA molecules that comprise a hybridizing region complementary to two regions. Preferably, each region comprises at least 5 contiguous nucleotides of a mRNA molecule encoded by one of the inventive polynucleotides. Ribozymes possess highly specific endonuclease activity, which autocatalytically cleaves the mRNA.

The genetic constructs of the present invention further comprise a gene promoter sequence and a gene termination sequence, operably linked to the DNA sequence to be transcribed, which control expression of the gene. The gene promoter sequence is generally positioned at the 5' end of the DNA sequence to be transcribed, and is employed to initiate transcription of the DNA sequence. Gene promoter sequences are generally found in the 5' non-coding region of a gene but they may exist downstream of the open reading frame, in introns (Luehrsen, *Mol. Gen. Genet.* 225:81–93, 1991) or in the coding region, as for example in a plant defense gene (Douglas et al., *EMBO J.* 10:1767–1775, 1991).

A variety of gene promoter sequences which may be usefully employed in the genetic constructs of the present invention are well known in the art. The gene promoter sequence, and also the gene termination sequence, may be endogenous to the target plant host or may be exogenous, provided the promoter is functional in the target host. For example, the promoter and termination sequences may be from other plant species, plant viruses, bacterial plasmids and the like. Preferably, gene promoter and termination sequences are from the inventive sequences themselves.

Factors influencing the choice of promoter include the desired tissue specificity of the construct, and the timing of transcription and translation. For example, constitutive promoters, such as the Cauliflower Mosaic Virus 35S (CaMV 35S) promoter, will affect the activity of the enzyme in all parts of the plant. Use of a tissue specific promoter will result in production of the desired sense or antisense RNA only in the tissue of interest. With genetic constructs employing inducible gene promoter sequences, the rate of RNA polymerase binding and initiation can be modulated by external stimuli, such as light, heat, anaerobic stress, alteration in nutrient conditions and the like. Temporally regulated promoters can be employed to effect modulation of the rate of RNA polymerase binding and initiation at a specific time during development of a transformed cell. Preferably, the original promoters from the gene in question, or promoters from a specific tissue-targeted gene in the organism to be transformed, such as eucalyptus or pine, are used. Other examples of gene promoters which may be usefully employed in the present invention include mannopine synthase (mas), octopine synthase (ocs) and those reviewed by Chua et al., *Science* 244:174–181, 1989.

The gene termination sequence, which is located 3' to the DNA sequence to be transcribed, may come from the same gene as the gene promoter sequence or may be from a different gene. Many gene termination sequences known in the art may be usefully employed in the present invention, such as the 3' end of the *Agrobacterium tumefaciens* nopaline synthase gene. In one embodiment, terminator sequences are those from the original enzyme gene or from the target species to be transformed.

The genetic constructs of the present invention may also contain a selection marker that is effective in plant cells, to allow for the detection of transformed cells containing the inventive construct. Such markers, which are well known in the art, typically confer resistance to one or more toxins. One example of such a marker is the NPTII gene whose expression results in resistance to kanamycin or hygromycin, antibiotics which are usually toxic to plant cells at a moderate concentration (Rogers et al., in *Methods for Plant Molecular Biology*, A. Weissbach and H. Weissbach, eds., Academic Press Inc., San Diego, Calif., 1988). Transformed cells can thus be identified by their ability to grow in media containing the antibiotic in question. Alternatively, the presence of the desired construct in transformed cells can be determined by means of other techniques well known in the art, such as Southern and Western blots.

Techniques for operatively linking the components of the inventive genetic constructs are well known in the art and include the use of synthetic linkers containing one or more restriction endonuclease sites as described, for example, by Sambrook et al., *Molecular cloning: a laboratory manual*, Cold Spring Harbor Laboratory Press, Cold Spring Harbor, N.Y., 1989. The genetic construct of the present invention may be linked to a vector having at least one replication system, for example *Escherichia coli*, whereby after each manipulation, the resulting construct can be cloned and sequenced and the correctness of the manipulation determined.

The genetic constructs of the present invention may be used to transform a variety of target organisms, including plants, both monocotyledonous angiosperms (e.g. grasses, corn, grains, oat, wheat and barley), dicotyledonous angiosperms (e.g. Arabidopsis, tobacco, legumes, alfalfa, oaks, eucalyptus, maple), and gymnosperms (e.g. Scots pine (Aronen, Finnish Forest Res. Papers, vol. 595, 1996), white spruce (Ellis et al., *Biotechnology* 11: 84–89, 1993), and larch (Huang et al., *In Vitro Cell* 27:201–207, 1991). In a preferred embodiment, the inventive genetic constructs are employed to transform woody plants, herein defined as a perennial tree or shrub whose stem increases in diameter each year by the addition of woody tissue. Preferably the target plant is selected from the group consisting of eucalyptus and pine species, most preferably from the group consisting of *Eucalyptus grandis* and *Pinus radiata*. Other species which may be usefully transformed with the genetic constructs of the present invention include, but are not limited to: pines such as *Pinus banksiana, Pinus brutia, Pinus caribaea, Pinus clausa, Pinus contorta, Pinus coulteri, Pinus echinata, Pinus eldarica, Pinus ellioti, Pinus jeffreyi, Pinus lambertiana, Pinus monticola, Pinus nigra, Pinus palustrus, Pinus pinaster, Pinus ponderosa, Pinus resinosa, Pinus rigida, Pinus serotina, Pinus strobus, Pinus sylvestris, Pinus taeda, Pinus virginiana*; other gymnosperms, such as *Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Juniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea* sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata; Eucalypts, such as Eucalyptus alba, Eucalyptus bancroftii, Eucalyptus botyroides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nicholii, Eucalyptus nitens, Eucalyptus novaanglica, Eucalyptus obliqua, Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus torelliana, Eucalyptus urnigera, Eucalyptus urophylla, Eucalyptus viminalis, Eucalyptus viridis, Eucalyptus wandoo and Eucalyptus youmanni; and hybrids between any of the above species.

Techniques for stably incorporating genetic constructs into the genome of target plants are well known in the art and include Agrobacterium tumefaciens-mediated introduction, electroporation, protoplast fusion, injection into reproductive organs, injection into immature embryos, high velocity projectile introduction and the like. The choice of technique will depend upon the target plant to be transformed. For example, dicotyledonous plants and certain monocots and gymnosperms may be transformed by Agrobacterium Ti plasmid technology, as described, for example by Bevan, Nucleic Acids Res. 12:8711–8721, 1984. Targets for the introduction of the genetic constructs of the present invention include tissues, such as leaf tissue, dissociated cells, protoplasts, seeds, embryos, meristematic regions; cotyledons, hypocotyls, and the like. One method for transforming eucalyptus and pine is a biolistic method using pollen (see, for example, Aronen, Finnish Forest Res. Papers vol. 595, 53pp, 1996) or easily regenerable embryonic tissues.

Once the cells are transformed, cells having the inventive genetic construct incorporated in their genome may be selected by means of a marker, such as the kanamycin resistance marker discussed above. Transgenic cells may then be cultured in an appropriate medium to regenerate whole plants, using techniques well known in the art. In the case of protoplasts, the cell wall is allowed to reform under appropriate osmotic conditions. In the case of seeds or embryos, an appropriate germination or callus initiation medium is employed. For explants, an appropriate regeneration medium is used. Regeneration of plants is well established for many species. For a review of regeneration of forest trees see Dunstan et al., Somatic embryogenesis in woody plants. In: Thorpe, T. A. ed., In Vitro Embryogenesis of Plants. Vol. 20 in Current Plant Science and Biotechnology in Agriculture, Chapter 12, pp. 471–540, 1995. Specific protocols for the regeneration of spruce are discussed by Roberts et al., Somatic Embryogenesis of Spruce. In: Synseed. Applications of synthetic seed to crop improvement. Redenbaugh, K, ed., CRC Press, Chapter 23, pp. 427–449, 1993. The resulting transformed plants may be reproduced sexually or asexually, using methods well known in the art, to give successive generations of transgenic plants.

As discussed above, the production of RNA in target plant cells can be controlled by choice of the promoter sequence. A target plant may be transformed with more than one genetic construct of the present invention, thereby modulating the activity of more than one polypeptide, affecting polypeptide activity in more than one tissue, or affecting polypeptide activity at more than one expression time. Similarly, a genetic construct may be assembled containing more than one open reading frame coding for an inventive polypeptide or more than one non-coding region of a gene coding for such a polypeptide. The polynucleotides of the present invention may also be employed in combination with other known sequences encoding polypeptides involved in plant cell signaling.

The isolated polynucleotides of the present invention may be employed as probes to isolate DNA sequences encoding polypeptides involved in cell signaling from other plant species, using techniques well known to those of skill in the art, such as routinely used DNA hybridization and PCR techniques.

The inventive polynucleotides, polypeptides and antibodies to such polypeptides may be used to screen for molecules that interact with such polynucleotides and/or polypeptides and that thereby modulate cell signaling. Techniques for performing such assays are well known in the art. Similarly, the polynucleotides and polypeptides of the present invention may be employed in studies designed to elucidate the mechanism of cell signaling pathways.

The following examples are offered by way of illustration and not by way of limitation.

EXAMPLE 1

Isolation, and Characterization of cDNA Clones from Eucalyptus grandis

Eucalyptus grandis cDNA expression libraries were constructed and screened as follows.

mRNA was extracted from specific plant tissues, such as trunk xylem, using the protocol of Chang et al., Plant Molecular Biology Reporter 11:113–116, 1993, with minor modifications. Specifically, samples were dissolved in CPC-RNAXB (100 mM Tris-Cl, pH 8,0; 25 mM EDTA; 2.0 M NaCl; 2% CTAB; 2% PVP and 0.05% Spermidine*3HCl) and extracted with chloroform:isoamyl alcohol, 24:1. mRNA was precipitated with ethanol and the total RNA preparation was purified using a Poly(A) Quik mRNA Isolation Kit (Stratagene, La Jolla, Calif.). A cDNA expression library was constructed from the purified mRNA by reverse transcriptase synthesis followed by insertion of the resulting cDNA clones in Lambda ZAP using a ZAP Express cDNA Synthesis Kit (Stratagene), according to the manufacturer's protocol. The resulting cDNAs were packaged using a Gigapack II Packaging Extract (Stratagene) employing 1 µl of sample DNA from the 5 µl ligation mix. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing 5-bromo-4-chloro-3-indolyl-β-D-galactoside (X-gal) and isopropylthio-beta-galactoside (IPTG).

Of the colonies plated and picked for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained by designing primers to hybridize to the ends of known sequences, and using these as sequencing primers extending the amount of sequence information. This procedure was repeated iteratively until the complete sequence was obtained. Alternatively, internal sequence was obtained by generating "nested" deletion clones of the gene of interest using published methods (Henikoff, *Gene* 28:351–359, 1984).

The determined cDNA sequence was compared to known sequences in the EMBL database (Release 58, March 1999) using the computer algorithms FASTA and/or BLASTN. Multiple alignments of redundant sequences were used to build up reliable consensus sequences. Based on similarity to known sequences from other plant species, the isolated DNA sequences were identified as encoding RLKs (SEQ ID NO: 2, 8, 9, 11, 15, 18, 19, 21–25, 33, 34, 38, 131–301, 448–463, 848, 858–874, 882–887, 946 and 947) or at least one member of a two-component signaling system (HKs, RRs or hybrid HK/RR proteins; SEQ ID NO: 42, 48–52, 55–58, 67, 464–471, 474–478, 850–857, 948–952 and 960–974). The sequences of SEQ ID NO: 2, 8, 9, 11, 15, 18, 19, 21–25, 33, 34, 38, 946 and 947 were found to have less than 10% identical residues (determined as described above) to known sequences. In addition, the 5' UTR regions of SEQ ID NO: 856, 961 and 963 are each believed to contain an internal ribosome entry site (IRES). IRESs may be employed to control gene expression without the use of specific promoters (Sachs, *Cell*, 101:2430245, 2000).

SEQ ID NO: 848, 854, 855, 856, 859, 860, 862, 863, 864, 865, 866, 867, 868, 869, 871, 872, 873, 874, 882, 883, 885, 946, 947, 948, 949, 950, 951, 960, 961, 963 and 967 represent extended sequences of SEQ ID NO: 232, 467, 468, 48, 282, 288, 488, 453, 289, 268, 297, 278, 290, 449, 299, 301, 270, 269, 276, 454, 300, 450, 280, 851, 49, 470, 57, 50, 948, 951 and 854, respectively. SEQ ID NO: 962 is a splice variant of SEQ ID NO: 961. The sequences of SEQ ID NO: 848, 854–856, 859, 860, 862–865, 868, 869, 871–874, 946, 947, 949, 950, 960–964, 967 and 971–973 are believed to be full-length sequences, in that they each contain a complete open reading frame.

EXAMPLE 2

Isolation and Characterization of cDNA Clones from *Pinus radiata*

A *Pinus radiata* cDNA expression library was constructed from specific tissues, such as xylem, and screened as described above in Example 1. DNA sequence for positive clones was obtained using forward and reverse primers on a Perkin Elmer/Applied Biosystems Division Prism 377 sequencer and the determined sequences were compared to known sequences in the database as described above.

Based on similarity to known sequences from other plant species, the isolated DNA sequences were identified as encoding RLKs (SEQ ID NO: 1, 3–7, 10, 12–14, 16, 17, 20, 26–32, 35–37, 39–41, 302–447, 833–847, 875–881 and 888) or at least one member of a two-component signaling system (HKs, RRs or hybrid HK/RR proteins; SEQ ID NO: 43–47, 53, 54, 59–66, 472, 473, 479–481, 849 and 968–970). The sequences of SEQ ID NO: 3–7, 10, 12–14, 16, 17, 20, 26, 28–32, 35–37 and 39–41 were found to have less than 10% identical residues (determined as described above) to known sequences. In addition, the 5' UTR region of SEQ ID NO: 47 is believed to contain an internal ribosome entry site (IRES). As noted above, IRESs may be employed to control gene expression without the use of specific promoters (Sachs, *Cell*, 101:2430245, 2000).

The sequence of SEQ ID NO: 480 was found to contain a putative unspliced intron and the translation is split into two ORFs. The predicted amino acid sequences encoded by these two ORFs are provided in SEQ ID NO: 830 and 831. SEQ ID NO: 411, 413, 317, 421, 415, 434 and 416 represent extended sequences of SEQ ID NO: 26, 17, 28, 39, 16, 30 and 41, respectively. SEQ ID NO: 833, 834, 835, 836, 837, 838, 839, 840, 841, 842, 843, 844, 875, 876, 877, 878, 879, 880 and 888 represent extended sequences of SEQ ID NO: 411, 413, 317, 29, 421, 415, 434, 416, 35, 37, 36, 40, 438, 426, 445, 418, 435, 411 and 427, respectively. The sequences of SEQ ID NO: 833–837, 839–841, 844, 878–881, 968 and 969 are believed to be full-length sequences in that they contain a complete open reading frame.

EXAMPLE 3

Use of an Ethylene Receptor Gene to Modify Plant Growth

Transformation of tobacco plants with a *Pinus radiata* ethylene receptor gene homolog is performed as follows. Genetic constructs comprising sense and anti-sense constructs containing a DNA sequence including the coding region of an ethylene receptor homolog (SEQ ID NO: 43) from *Pinus radiata* are constructed and inserted into *Agrobacterium tumefaciens* by direct transformation using published methods (An: Binary Vectors. In: Gelvin S B, Schilperoort R A, eds., *Plant Molecular Biology Manual*, Kluwer Academic Publishers, Dordrecht, 1988. The constructs of sense DNA are made by cloning PBK-CMV plasmid cDNA inserts into pART7 plasmids, followed by cloning of the NotI-digested 35S-Insert-OCS 3'UTR-fragments from the pART7 vectors into pART27 plant expression vectors; (Gleave, *Plant Mol. Biol.* 20: 1203–1207, 1992). The presence and integrity of the transgenic constructs are verified by restriction digestion and DNA sequencing.

Tobacco (*Nicotiana tabacum* cv. Samsun) leaf sections are transformed with the sense and anti-sense ethylene receptor constructs using a method based on that of Horsch et al., *Science* 227:1229–1231, 1985. Transformed plants containing the appropriate construct are verified using Southern blot experiments. Expression of the Pinus ethylene receptor homolog in transformed plants is confirmed by isolating total RNA from each independent transformed plant line created with the sense and anti-sense constructs. The RNA samples are analyzed in Northern blot experiments to determine the level of expression of the transgene in each transformed line. The expression level of the ethylene receptor polypeptide, encoded by the Pinus ethylene receptor gene and by the endogenous tobacco ethylene receptor gene, for each transformed plant line created with the sense and anti-sense constructs is compared to that of wild-type control plants.

SEQ ID NOS: 1–989 are set out in the attached Sequence Listing. The codes for nucleotide sequences used in the attached Sequence Listing, including the symbol "n," conform to WIPO Standard ST.25 (1998), Appendix 2, Table 1.

All references cited herein, including patent references and non-patent publications, are hereby incorporated by reference in their entireties.

Although the present invention has been described in some detail by way of illustration and example for purposes of clarity of understanding, it will be apparent to those skilled in the art that changes and modifications can be carried out without departing from the scope of the invention which is intended to be limited only by the scope of the claims.

SEQUENCE LISTING (989 sequences)

SEQ ID NO: 1 - DNA, 2389 bp, Pinus radiata
atctactggtagtgctaatcccaatctcattccagtgggtcattaacatgggctgagaggtttcaaaatctttatatggttgttgaagtatccacttcctgtgccaatcttattctcattctctgccgttacaatggagaggctggagatggcgatgtttttaatgttactgattatctttttctttagagattgtgaagcccagggcaaatcggattatcatgcactgatagctttcaaggcctcctctgatatcaataacactctggcgttctcatggacacataagaatccatgcagacgaaagtggtatggagttgggtgtgagaatggccgggtagtgaggcttgtgctccaggatctcgacctcgtgggtccgattgatgccttaacaggtctccatgagctcagaattctgagcttgaagagaaattcactcaatggcaccattcctgattttttgaactggagaagtcttaagttcctgtttctctctgataactatttctcaggtcccttgccttctaccattgcttctttagatcatctcttgagattggatgtatcgaacaatcatcttggcggtcaaataccattgagtattacttcaatgacccatttgcttactctgaggcttgagaacaatgagttctctggcagcatttcagacttgatgttgcccaatactgtggaagaattcaatgtttcagacaatagacttagtggcatgatacctgcaagtctgtctaggtttccaagctctggatttgtgaataatgaagaactctgtggaagtcccctgcagagttgcaatgaaagtaacaatgcaagctctgcttctaatccctacatggcttccagcccctccatgatttcaggctcactgccagtgcatagaaataatagctctacgcaactcagcaaaggtgatattatagcaatagttgtgggagatgttgcagtgttatcgctcataggttgtgtaatcttctgctactactggaaaaagaagggtgtaaaacagaagaagcctaagcctaagcctgcccagagatgtccaacagacaggttagctgtgcattcttcagatcagtgccctaataatcagtctattactgcaggaaaatgcaagcttatcttctttgatgatggaagaccttttgagctagagcatctcttgcgagcttcggctgaaatgctaggaaagggtaactttggaagcgcttataaggctattatggaagatggatctgttgttgctgtcaagagattgaaagatttgtatggtattggaaggaaggagtttgagcaacatatggagctcatgggaagtttgagacatcaaaatgtagttaatttaagggcctattattttgctagagatgaaaagcttctggtctatgactatatgccaaatgggagtctgtatgcacttcttcatggtagccgaggacctggtagaacacccctagactggacaactagaatgaagatagcacttggtgcagctaaaggcttggcatttattcacagccactgcaagtcacccaagattggccacggaaacatcaagtcttccaatattttgttagacagaaatgggaatgcttgcatttcagactttggccttgcactgctggtgagtccatcagttgctgcttcacgaatggtgggctacactgctcctgagcaagctgcaacaaagaagatatcccagaaagcggacgtgtacagctttggagttttactgcttgaaatgctaactggcaaggcccctgttcaagctcacatgcaagaggattatcattcagctatagatcttcccaggtgggtgcagtccattgtcccagaagaatggacatcagaggtatttgatattgagttgatgagattcaaaaacattgaagaggaactagtaagcatgcttcagattgctttgctctgtgcctcacaatctcctcagcaacgccctaaaatgagccatgtggtgagggtgattcaagacattagaggagatcaccactctccctccatgcagaattctctatctcaatctccttccatgcaagaaccaggtcattctatatcagattctccttctgtatcagaggactcgggaataagaggcctgtgagtttgtgtatttgttctcattagaatccaatttgcttgaatttaattgcaggtattctttagcagcatccttttggatgggcatttaactagctgtagcataagagtgtagcatatgcttaaatgggcatttaagtatatgcagtgtgtaggaggaggtatattttagaagacttggatttggttttttcttgaagtatccatatccatattaaaagagttggtattttggttaagatccaaaaaaaaaaaaaaa

SEQ ID NO: 2 - DNA, 2568 bp, Eucalyptus grandis
agagagatgggtttcgcttccttgcgctcgcagtgtctcttcttcttcctcctctgggtcttcatcttcttcgccagccgaagcgacgtgcttgtctccgcagcaacgagcgcggagctgagagctctcatggacatgaaagccagcctagacccggaaagcaggtatctttcctcgtggaccgtcgatggcgatccttgcgacgggtccttccaaggcgtctgctgcgacgacgagggccgcgtcgccaacgtttcgctgcaggggagacggctcaccgggaggctctctccggccattgctgggctcacccacttgactggcctttaccttcactacaactccctgtgcggagagattccgcgagagctcggcaacttgagcgcgctcagcgacttgtatctgaacatgaacaatctctccggccagattcctcccgagatggctgacgtcgcaagcttgcaagttatgcagctctcttacaaccagttgactggaagtatacctacaaagctgggatctctgaagaagctcagtgttcttgctctgcaatctaatcagctcactggcgcaataccggcaagtttaggtgacctggggacgttgacgaggttatatttgagtttcaatcgcctctttggctcgattcccatgaagatagccgatctgcctcttctagaagtcttggatgtccaaaacaacactctctctggcaatgtacctcctgcgctgaagagactgaacgaaggatttctgtacgaaaacaacttcgacttgtgtgggactgggttcctctctttaaggacttgtaatgctttggagggtcgaaagcctagtcaacctcaaccctatggggctgcgacaacagtaccctccacaagtatacccgagacggccaatgtggtgttaccatgtaacctgactgaatgttctagtttgccaaaatcagcgcatccctctgcgcttattggatcaatcttggcaactgttgcattgtcggccatagggttccttttgttcacacactaccgtcggaggaaacagaaacttggcttttcggctgaggtttgtgatggccatctgagcactgatcaacccaagagtgcttataagaaaaatggctctcctttagctagcctggagtattccaacggatgggatccgcttgctgatgctcggatctttaatgagttttctgaagaagctttccagagcttcagattcaatctggaagaggttgaatccgccactcagtatttctcggagttgaatgtgttgggtaagagtaatttctctaccacatacagaggaatcctgagagacggttctgtagtctccatcaaatgcatcaataagactagctgcaaggctgatgaatcagagttcttgaagggtttgaatatgttgacctcactgagacatgaaaatctggtgaggctgagaggattctgctgctcaacggcccgtggtgagtgcttcctgatatatgattatgttccgaatgggactctgctaagctttttggatttggaggagggggacagtggcactcttgagtggtccactagagtttcgattgtgaagggaatcgctaaaggtattgcctatttgcacgctcacaaaccaaacaaggcccccctccttcaccaaaacatctcagcagacaaggtgctcatagaccagcgattcaatccgttgctctaccaatctggtctccacaggctcctgacaaatgatgttgtgttctcgttgctcaaagctagtgctgccatgggctacctagcgcctgagtacatgtccacgggccggttcacagagaagagtgatgtctacgcgtttggaatgatcgtgttccagatcttgtcggggaagcagaaagtagatcactccatgcgtctggctgctgaatcgtgtagattccaagaattcattgatgcgaatatccatggaaggttcttcgagtacgaggcagctaaacttgcaaaaatcgcctcgctctgcaccaacgagtctccttatgacaggccatccatggacgccgtgattcacgagctgagtaactgtagcagctgtctctgattgtgaggccttattggagtaaatgttccaggagctgttgcaaaagtcaatggtagaagttggtctgaaaaagctccctgcgctgccactaatgttgtaacctaccggctttgacatctttttgatttggtgcctttgccttagggccgtgctttcttgtgtatgttcaagcctggtagggatgaatgactttaattcacgcatgtatgattgcttttcaaaatattttctttagaagtaggttcatttcggaattagattttcgatatttctcgttgcgtgccgcagttgtgtgggtgaaaatggccgtggacttccaacgccggtaactagccttgttgccgtggtcgcattgcattagccctgcctggcatctttaattgctggttaattgaggcgatttgtttttccattggtggatctgctggcatctttaattgctggttaatcgaggcgatttgtttttccgtaaaaaaaaaaaaaaaaaaa

SEQ ID NO: 3 - DNA, 2686 bp, Pinus radiata
gacgaggatccccaaggcccattgctttattgcctggaaagaattttaaagcttatatatatattattgttgctctataatagtaatgataaatttaggcctaggcataggtgtgtcattgccattcttagaagcaatgcctggcactggtcactgcccacagtccagctctcaaagcctgtcctgtagctgttgtctcaatgccttgtcttactttgtgagctggtgtctgtcatggaggtagaggaagaatcatttggcttttaagttttaccccatttttcttcagtaagaagaagtgcctccatggtttgcagcagatcggagctttgctgagacgcgattaggtaacccgtctgcgacaattttttctctgcaatgtgggtttgttgggcattttacagaagcatgactggcagagaagaatagcagcaagtatatatctctgtttttggcttgctgtgatgtattggtcgcagatggggaatatacggcagctttttaatggtttcttcatgctggtgctagtagtggccgtggttaagggggagccaacgggcgataaacaggcccttctcgattttctcagcaaggttccccatgggcgaaggctaaactggaatgccagcagctcagcttgtacttgggttggagtgacctgcaatagtaacaaggatcgcatctgggaagttagattgccgggcgtgggactctttggaccgattccccctggcactctggggcgtctgacggagctcagagttctttccctgagatcaaatttgctcaccggttctctgccttcagaccttgcaaatgccaaggctctgagaagtatctatcttcagcataacttgttttccggaccattgcctccgtttctgtctcaatgggggcgcttgagtcgactggatctttccttcaatcgtttgaatgggtctattcccttttccttgaataacctcacgcatctcactggtctcttgttgcagaacaattcgctgagtggaagcatacccaatctcaacatccagaacttgactctgttgagtgtggccaacaatcagctcaacggttcgattcctaggtcgcttcagaagtttcccaagacttctttccaaggcaatgctcagctctgcggggttccattaaaactgtgcaaatcgtttttcccgtcgccttctccctctcccaacggttctgctgtgccccggaggtccaagaaatcgaagctgagcaccggcgtggtcgtggctatcatcgtgggcgccgttgctgtgctcttcttgttgctggcatgcctatttttgtgctgcgttagaaagcacaggggcgagagtgcgacggagaagcctcagaaagacgagcggaccacggtcgagaagggcgggccttctaaggaggaatacatggggactgcccaggagacagagcgcaataagctcgtattcttcgagggcagccagtatactttcgacctggaagatcttctccgcgcttctgcagaggttctggggaaaggaagcgtggggacggcctacaaggcagtgctggaagatgggactactgttgtggtcaaacgcttgaaggacgtggctgtcaacaggagggattttgaacagcagatggagctggtgggaaggatccgtcacaggaatttggtgcccttgagagccttctacttttccaaagatgagaaattactcgtctatgactatatgcccgctggcagcttatcagcccttttgcatggtagcagaggctctggccgcacacctttggattgggaaaccaggatgcggattgctttgggtgctgcaaggggcatttcccacatccacgaagaaggcggaggcaaattcacccatggaaacataaagtcatccaatgttctgttaacgtccgatttggatggctgcgtctcagacttcggcctcgttccattatttagcgctgctgcagcagcaaaccgcatcgctggttacagagccccggaggtcatagagactcgcaaggtcacacagaaatccgatgtctacagcttcggtgtgctactcctagaacttctcacaggcaaggctcccaaccaggcctctctcaacgacgagggcatcgatctgccaagatgggtacaatccgtggttcgcgaggagtggacagcagaggttttcgacgtggaattaatgaggtaccaaaacatagaagaagagatggtccagttgctgcagattgccatggcctgcgttgctacagtgcctgatcagaggcccagaatgcaagacgtggtgaagatgatcgaggacatgaggcagttcgaaacagacgaaggaaatagacaatcctctgatgataaatcgaaagaatccaatggacaaactcctccccagcaagccacaccagaagcacgcacccccacagcaagaacaccgtgacagcaccccctcagcaagcacactttgacagtcgaaattcttctgtttctgtccatattataacacagttgccagtatcatgggcttttcgtgattgatttcatttatatccagtatttcagtaaagtaatttcaccgcggaattgcttgctttatattccggttttcgttccccttttcttggctcgctggtgatcttcaagcattcttgaaataggcaccacactacactacattcgtgctcatttgattgg

SEQ ID NO: 4 - DNA, 2868 bp, Pinus radiata
gaacacaatgcgggtctgatgtctctccgcgggtttgaagcctgacgaggctgctccctagggttgagttggaggttgctgcgggagcgggaggcgggggcgaggctgatcatgagatctggattgtgaatccgcgtggatccgtggatgatttaacggggcgaaagatcgagtctcgtccccgagggctaagcaggcggttgaaataaagaggtgaagttattttgagcggagtcatgcagcagccgtatgttgtactcgccctgttgtggatgctgctgctgcatcacccgctctggcgagtttttgctaatacagaaggtgatgctttacatagccttcggtcgaacttactggacccaaacaatgtgcttcagagttgggatccaaccctcgtcaatccatgtacatggtttcatgttacatgcaacaatgataacagtgtgataagagtggacttgggaaatgcacaactttctggttcattggttccccagcttggcctactgaacaatctgcagtacttggagctttatagcaacaatataagtggtcccatccccagtgatttaggcaacttgaccaatcttgttagcctggatttatacctgaacaatttcactggtctaatcccggagtcactgggcaaactgtccaggttacgcttccttcggcttaataacaacagtcttgtaggacggatcccaatgtctctcacaaccattactgctcttcaagtccttgatctgtcaaacaataatctcacaggagaggttccagcaaatggttcattctctctatttactcctatcagtttcggtggcaatcaatacctgtgtggtccagtggcacaaaagccatgtccgggatctcctcctttttctcctcctcctccgtttgtaccacccccgccagtagctggaagcaatggagcaagggtgcagagctcttccagcacaggagccattgctgggggagtagctgcaggtgctgccctcttatttgcagctcctgcaattgggttcgcctggtggcgtcgcagaaagccacaggagcacttctttgatgtacctgctgaggaggatccagaagttcacttaggccaacttaagaggttctcattacgggaattacaggttgcaactgatggttttagcaatagaaacattcttggcagaggtggttttggaaaggtgtacaaagggcgccttgcagatggttccttggtggctgtaaaacgtctgaaggaagagcgtacaccgggtggagagttgcagtttcaaacagaagtggagatgataagcatggcagtacataggaacctccttcgactacgtggattctgcatgacacccactgaacggctgcttgtttatccctacatggccaatggaagtgttgcttcatgcctacgagagagggcacaaaatgacccacccttagattggccaactcgcaagcgcatagcattgggttctgcaagaggtctctcctacttgcatgatcattgtgatcctaagattattcaccgggatgtcaaggctgctaacatcttactggatgaagaatatgaggcagtggtgggggattttggcttggcaaaacttatggattataaggacacacatgttacgacggctgttcgtggaaccattggccacatagcacctgagtacctttctactggaaagtcttcggaaaagacagacgtatttggatatggaatcatgttgctggaacttattacgggacaacgggcatttgaccttgcacgtttagcaaatgatgatgatgtcatgttgcttgactgggttaaaggcctactaaaagagagaaggcttgatatgctagttgatcctgatcttaagaacaattatgttgaagcagaggtggaacaacttattcaagttgcattactttgtacacaagggtcaccaatggatagaccaaagatgtctgaagtggtaaggatgttggaaggggatggcttagctgagagatgggaggaatggcaaaaggtggaagtcgtacggagccaagaagttgaacttgttcctcatagaaattcagaatggattgtcgactcaacagataatcttcatgcagttgaattgtctggtccaagatgataagagttgaattgtttattcaatctttgcaaatccataattttattgagtccaaattacaatgtcaatatgtatcgaggttgaatcgatgtatcattttcaagcatattttagtagatgcgtcaatgtgcgaatgtagagaatattcgttgcaagtccttagatggctatgctgggttttgtcccatgagaatttctgtcgggttgcagtcaaacccgaaagttagaaggatttcttatggtgcatcccatccaggcaaagatctgggctcctgtattatgaatggtttgctctaggaatcgaagctccatttctgctattgaagacttcctttttcagtgctaatatgtatttaaacagtctgtccacttgacatatgcaactacttttcctgccgagagtgtactttgataagaccacaatcttttgagactagtactaaatttggtctcagtttcaaatccagagtggaaaatgaaggaaaacaaatttcatgaataccaagattctgctaaatcccttgagctgggctcttaattctcgataatcctccggagtttgagaaagatgtatgttgtcaaaggtagatctcaagctagtgaattccttagtttcacagaattgttttcttagagccagacacatgctcctgaattacattaaatttactttttgtggtgttcaaattgaaatacagaaactatgactgttttaatgacattggcagctaacggaccg

SEQ ID NO: 5 - DNA, 3340 bp, Pinus radiata
gattaccataatgcttctcctcgccactctttctttcattctctttctcaatccttttgccttttccacacccatcgcccatttccctcaccatcctcctcgtctcaccaatgcttccgatcaacacgctctgcttgcattcaagtctgcaatcacatatgatccctcacagtccttggccacgtcttggttgccaaatgtgtcattctgccagtggacgggcatcatatgcagcaggcgcagacagagagttatttccctcaatgtttcgagcatgggattacaaggtacaatctctccccttctcgccaatctctcctttcttacagtactcgaccttcacaacaacagtttcgactgccacattccctatcaattgggaaccctctttcgcttaaagatgcttcgcctgtctaagaatcaactccagggttccattccgcccactctggctaattgtcgcagtttacggaacttgactctctcctttaacaacctcacgggaaacattcccccacaactatgccttctccccaacctaatatgtatgtccttgggaattaacaatttgacgggaacaatcccggactgcttgggaaacatatcctctttgcagtacttatctttgagtcaaggtaaccttcagggcagtgtcccttccgaattgggtaggctaagccagctcatcgttcttgatctgtttgggaaccatctcacgggatgcattccgtcttcgttgtccaactgcaccaatcttgaactattggatataggtgataaccaattagttggccacattccgtcgcatttgtgtaccaagaagaccacccagttaatgtatctccgtctgggtgctaatcagctaagtggcagcgttccttcatccctcttcaattgtaccaagttacaagagattgccttaccatataaccagctcagcggaatagtgcctatggagttgggtaaattgacacatctccagcggcttttctttggcgggaattactttattagcggcaacaccatgagatgccccattcttactgctcttagtaactgttctgatctacaatatgtagacttatctgagaataacttcactgggcaattgccgttttctataggccacctctccaaaaaactctaccatttagacttgggtagcaacgaattagctggagaaatacctccggctattggaaatttaagtagcctaacattccttaatttaggacgtaattattttacagggtcaatcccatcttcacttattatgcttcagaagttggagaggttatatatggattccaataatttacaaggaaacattccaatggaaattgggcagctaaagagcttaggtctcttatatctttctggaaataatttgtctggaaaaatccctgattttgtggccaacctccagcaattaagatatttatatcttaatcataaccagttatcaggagatataaatgcaaatttagggaaatgtgtgaacttactactgctagatctatcatacaacaagcttagtgggcacatacctcaagagctcgcaggccttgcaaatttagccttctatttcaacttgtcaaacaatttattaagtggccatgtacctttagaactaggaaagttcgatatgcttcaagccatagatatttcggcaaatcaaataactggctacattccaagtatcgttggaagctggaaagaagtagcatatctgaatctttcttacaatgcacttgaaggtccaattccagtgtcaatcagtgaacttctaagtcttcaagacctagatctctcctccaacaatttgtcgggtggaatacctatatcactagcaaatctcacaatgctccatcacttgaatttttcttttaacaagttgtcaggggaagtccctaaagaaggagttttcaaaaatattggcgccacagcatttatgggaaatcttggtctatgtggaccttgggtaaatctaccaccgtgctatgctcataaacataaaagtgttttgaatctcaaaagagttatcatactggttgttgttgtagcaattgttgtattgtgtttgtttcttgcaatattgtggagaaagaattgtaggagaaatattcagagagacattggtccatcattaaatgtggggcatcgaagaatctcctatgcagagctcgtcattgcaacaaatgaatttagtgatgcaaacttgttaggaattggtagttttggaaaagtgtacaaagggattttgaatgatggcacaatggttgctgtcaagcttctcaatctacaaaatgaaggggctcaaaagagttttgatagagaatgcaaagttttgggtagagttagacaccggaatttgattcgggtcataacttgctattcagatctccaaatcaaagctttgatatttccattaatgccaaaaggaagcctagaaaagtggttatatcccgatgatggagaacaaagttgtttgaatttgattcaaaggttgaatatagcaatagatatcgcccaaggcatgacatatctccatcatcattgctttgtgcaagtgattcattgtgatttgaaacccaacaatgtgttgttgggtgaagatatgactgcatatttaatagactttggcattgctactatatgttttgcaaataatgaagatggagctctcacttccacaaatgcactcaaaggatctaccgggtacattcctccaggtattatttaaactatatcccatatgaagcaatcttatgattttcttatgtttacttaacattttcaattaaattaaaaaacttaagatgaggatctatgaatgcagaatatggagtgggaggacaagttacaaccaaaggtgatgtttatagctatggaatagtgctattggaaatgcttactagaaagaagcccacccatgacatatttgtggaaggaatgaacttgcaaaaatgggtgggtagtagttttccaagccaagtacaagaagtggtggacatgggtctgttaacgaggactagtagatgcattgaagaagataaagatctcaattgtctcagtgcactgataaatgtgggtttgctttgcacaaatgaatctcctcaaggacgacctacaatgatgggcattttaggcacattgcaaaacatcaaagactcttttttgagcactacttccattcccaaattccaatcaaatctaacacatttgttgggtagtacaagtgctactatcaacaacatttgtgaaggtcaaagttcttccacatcttagtctattgtaacaaagtagtggttatatgcttttttgtacataaaaaaaaaaa

SEQ ID NO: 6 - DNA, 3396 bp, Pinus radiata
ggaggaagcctgagacgaaatcattgcaggaggcggatgcccaacaaataggttgatgcagggattgcacgcattcttcatttatttgctgtgaaaaatgaggtattcctggacatgttctccctttctcagtctcctgttcattctttcatgtttagattctggaatttgtctcgataaccaacaaacacaggtgatgaaaaaactgtcgtcctacacaccctcatggacgactgtaaagtctgataacccatgtggatggagtggtgtgaattgcactgccgaagagagtaatgtgactgagcttcatatgtccggttttaggatgaagggcaatgcttggcagactatatgcaaacttcaagcccttcaagtgcttgacgtctctgataatttgctgtcaaccccgtctgataatgatatccaggcttgcaccaacttgttttcccttaacatcagctccaattttttgccaggctcctcccttccttcgcttgcaccgatgcgcaaactgcacttccttgatgtctctcacaatggatttgcaggggaatttggcccgcagattcagcatttgacagacctcagagtgctcaatttgacatacaataacttcagtggtccaatcccttcatttttaggaaatctgacgactttagaaaaaatcgatttctctcaaaattattttgagggtgaatttcccaaagagcttgtgcgttgcacaagtctgacttatctagacctcagcttcaatagactgacaggccaaatccctgataatattagcaaccttatccatttagaaaccctgattctgtcatcaaataatttaactggaacgattcctaaaacactggatcgacttgtcaatttgactcactttgcatcaaataagaatcagctcattggacgaatacctgttcagttagctaagctcacagaattacattttcttgatctgagctacaatgggttaaatgaaaccattcctccagaactttttgctttgagcaacttgcagactctggaccttacaaagaatttgctcacaggagagattcctcagaatttttcgagaaaattgataaggttgcgaataggccagaatcttcttaaaggaaacattcctttaacaattggaaattggtctaacttgacatacttagaaatgaatgataactcactagatgggcagattccgcagcagctggtaaattgtatcaagcttcaactacttgacctcggcaacaataatttgtcaggctcattaaccaatcagctgccttcacttctacagttgcaagtgttgaagttgcataataataattttgttggaagcattccatatatactgtcatctttctctaatttgtcatatgtcgatttgagtgacaatactttaaatgggtccataccctcaaatattttcaatctttcgaagctccaaaatttgcgcctacagaacaacaagctaacaggagcgattccaaacactgttggaggcagccaggtcttgttagagctccagttgggtggcaacaacctaactggaacaatgccattggaaattggcttcgtcagaaagttgcaaattcaactcaatctcagctgcaattctctagaaggggaaattccgaatactctttctggtttgtacatgctagaaatcttggatctttccaacaataaattgacaggagaagttccaggttctttgacagctatgctcagtctcacactgttgaacatctcaaacaatagtttaacaggcgtccttccaaaatttccaaattccacaagcgcgttgataattattgatacaggaaaccctggtctcactgctgggcaaaatggttccgctcctgccgcttctgcaaggaaaaaaatctcggcaattttgatcattggagttgctgttgcaggtgctgtctttgcaattgtggctgttggattgttcattgtggccagcaaatactttgggcgtggtgatcagcaaatgccagaagtgcaactagcccgtaagattgaaggccattttattcatccagatagtatccacaggctaaggattgactttgaaaagggtgttgaagccactctagatccggctaatgtcttcctaaagaacaagtttagtacctattacaaagctgtcatgccttctggcattagttattccgtgaagaagctcaactggagtgacagaattttcaaatctggaagctaccgaaagcttggtgcagaactggagaaacaggggaagctaaggcatcccaacatcctgacacccttggcacatgttctagacacagattctgcttaccttttctacgaatatgttcataaaggcagcctctcagaattccttcacactagtaatgtttctgtattggattggccatctcgttgcagaattgccataggtgtagcgcaaggtttggcttttctacacgggtgtcagcatccaatcttccatcttgatctcactaccaaaaacattctcctaaagtctttaacagagccacaaataggtgatattgagctttgcaagattgttgatccttccaagagcacagggagtatttctgcaattgctggttcagttggatacgttcctccagaatatgcatacactatgagagtgacggctgctggtaatgtctatagctttggcgtcattttgctagagttactgactggaaggactcccatcaccagtggaatggatcttgcaaagtgggttcagtcaactctctcaggggaggaaacatgggaacaaattcttgacacaggaatcagaaacttttccgtccaaatacagaatgagatgatcgcaatgctgaaagtagctctcagttgcgttagctcatccccagagtcgagacccaaaatgagaaatgtagtgggaatgctccagatggtcaggcaagttgcagaataaggttttacttcattcgacaatatatggatgagattttacttccctacaatataggagtgggaacggggtattctgttttatatttttaaggagactaaatctgtatagtattgtcgatatgattaggattcacatgaattcagacatggatatatgaggttgttaaaatgttggtattttttgctcaggttagcgtagttatgcagtaaagtgcttatgctagattatcatggttcatatcataaatctagtatacttccaagcacaaatgtataaatatatgtgtttctgatttgattaacggggaagttattgtcttcattggcattcaaccaaaatatcagttaaaggtagcaagtttatagaatgcttgtggctttcaaacatggtcctggcttgtggctaaatcatggtaattcaagaacacagtctatttgactaaaaaaaaaaaaaaa

SEQ ID NO: 7 - DNA, 2432 bp, Pinus radiata
tctcaaagctctcaatcccaccactattggacaagaatggcagaagtgaagaaaattgttgagagtttgtcgcattgcactgcacaatgtgtttcttgatgctctaaagtcccgctcatgtgagttattttcctgataccttatctgtacttgatgttacctgatgcatttcaagatcttgtttgatgcaaaggaggaaaaaattaagtcctctttcgatatgttgactgcctttctggtattgtgcttcactaccactgctgcgtctgctacacaactatctccttcgggcctcaactatgaagttgcagctctaatggcgataaagaatagtttgaatgatccacataatgtcttagagaattgggacatcaattcggtggacccatgcggttggaggatggtgacatgcacacttgaaggctctgtttctatattaggaattcagtgtcagaatttgtctggtagtttgtctccaagcattcgaaacctcaccaatcttcagtctgtgctacttcaaaataacgccatatcaggatcaatcccagctgagttgggaaagctagataagcttgatactcttgacctctccaacaatcatttcaatgggttgatacccagttcactgggaaaattgaaaaacctaaattacttgcggctcaacaacaacaacctatctggaccaattcccccatcactggctactatcacagggcttactctcctggatttgtcgtgcaataatctaagcggctctgtgccaagaatttctgctagaaccttcaatattgtgggcaaccctttgatttgtggtccgaattcaacatataagtgtcctggacaatttcccacgcctatcccattagttgttgagacaccgcaaggtagagttccttcaagacaatctaaaaccagaaagctggctgttgccttggtcgctagtcttggttttgtgtttgtggtttccattggacttctcctttggtggcgcaagagacacaatcagcaaattttcattgatgtcaatgaacagcacaatgttgatatttgtctagggcatttgaagagattctcattcaaagagttacgtgtttccactaataattttagtagcaagaatattttaggagtaggaggatatggaattgtctataaaggattcctacaagatggcactatagtagcaataaaaaggttgaaagatggtaatgtgggaggaggagaaattcaatttcaaacagaggtggaaatgatcagcttggctgtgcataggaacctattacgattgtatggattttgcacaacctccagagagaggcttctggtctatccctacatgccaaatggaagtgtggcctcttgtcttagagatcatattaatggaaagcttgccctggactggcctactcgcaagcgtatagcccttggagcagctaggggactgttatatttgcatgagcaatgtgatcccaagattattcaccgggatgtgaaagcagcaaatatattactggatgaatattttgaagctgttgttggagattttgggttagcaaagctcttggatcacagggattctcatgtgactactgctgttcgagggacggtaggtcacattgccccagaatacctttcaacgggacaatcttcagagaaaactgatgtatttggctttgggatattactgttggaactcattacaggacaaagggctttagattttggccaggctgcaaagcaaaaagttgtaatgctggattgggtaaagaagcttcatcaagagaagaagttgcacctccttgctgataaagatcttaagggcaattttgatagagttgagctagaagagatggttcaggtttctttgctatgcacccaatttcagcctggacatcgtccaaaaatgtgtgatgttttgagaatgttggaaggtgatggattgacagaacggtgggaaacattgcaaaaaattgaaaccccccgatacagagtaactgagatacccataacatattccgagttggttgaagaagattcttcttggcttgtccaggcaattgagctatctggtccccgttgatttcacaggcttgctaacattctaatatcaatgcttccatagcttgttgtctttgcatcttttgttggtgcccatggaaacatatgctggttcgttgtataggtagctttggtacagtcaaaatatttcgccatgcaccaaaaaatacggatacctttataattgtctctctatgtaatctcaggcaaacttaagcatattcagtattttttattgataagttggtagctttgcttgtaatggctatgctgtatcctcgcttgacacttcatcagcagcctagcttatttgatagtgaagggttttcacaagaactttctcagatggttgtaaatggttgttgagatatttc

SEQ ID NO: 8 - DNA, 2638 bp, Eucalyptus grandis
cgaggaccaaccgccaagaaccatgcatttacactctcttttactccattcataacctccgctccccagggcagagcaatccaagaatacccatctcattcttttgcagctgctgcatttcttgatctccccgccacaatgcatttccgaattctagccctcctgggcttcttcttcttggccgtcctcttcccctccgcggagccagatctcgcgtccgaccgcgccgccctcctcgcgctgcgatccgccgtcggcggccgcaccctgctctggaacgccaacctcccgagcccctgctcgtgggcgggcgtccagtgcgaggggaaccgggtcaccgccctccgcctccccggcgtcgccctgtccggccaaatccccgacggcgtcctgggcaacttgacccagctccgcaccctctcgctccggttcaacgcgctctccggcacgctcccctcagatctcgcgtcctgcgccgacctgaggaacctctacgtgcaaggtaacctgttctctggcccgatccctgcgtcgctgttcggcttgagtgatctcgtgaggctcaatctcgcgtccaataagttctcgggggactttcccgctggtttcggcaacttgactaggctcaagactctcttgcttgagaacaaccagctctctgggtcgatcccagctgacctgaagcaactcaagctcgagcagttcaatgtttctaacaacttgttaaatgggtcgatacctgagggcttgggggcttttgctacctcttcgttttccggtaactctctgtgcgggaagccgctggcttcttgctctcaagatattgctctgcctgccggcgagccttctggtagtccagggcagccaggaggaaagaaaaagaagctttcgggggctgtggtcgcgggcattgtgattgggtgcgtgttcgggttcatattcctcgtcatactgttgatctatctgtgccggaagaagggtagcaagaagtctagatctgtggacgtcgcgaccttcaagcaccaggaattggagattccaggtgagaaaccggtcggggaggtcgagaatggcggtttcagtaatgggtactccgtggcggcagctgcggctgcggccatgacaggaagtggaaagggggaagtgaatgggagtgctggtgccgcggcaaagaagttgatcttcttcggtaattctgcaagggcgtttgatttggaggacttgttgagggcttcggcggaagttctcgggaaagggaccttcggaacggcttacaaggcggttttggaggccgggatcacggtggccgtgaagaggctaaaggatgtcaacgtggctgcaaaggaattcaaggagaagatcgaagcagtcggggcaatggatcaccagagtctggttcctctgagggcatactattacagcaatgatgagaagcttcttgtctatgattatatgcctatgggaagcttgtctgcacttttacatggaaacaaaggagcaggaaggactccgctgaactgggaaatcaggtctgccattgcgcttggggctgcccgtggcatagagtacctacattcccaaggtccaatcgtctcccatggaaatatcaaatcctccaacatccttctcacgacatcatatgatgcgcgagtgtcagacttcggcctagcccaccttgtggggccttcctccactccaaaccacgtcgccggctaccgagcaccagaagtcaccgaccctcgtaaagtttcccaaaaggccgatgtctatagctttggggtgttgcttctggagctcctgactgggaaggcacctattcactctcaactcaacgaggaaggtgtggaccttcctaggtgggtccagtccattgttcgcgaggagtggacttccgaagtcttcgatctcgagctccttaggtaccagaacatcgaggaggagatggttcagttattgcagctcgcgatagattgtgccgcccaatatcctgataagcgtccttcaatgtccgaagtgaggagccaaatcgaagagctatgtcattctagctcgcagaaagatcgtgccccgcagcttgaccaggtcaatgaagtgaacgatgacacgtcttctcggtgagttgatttccgagattggcgagcgaaattcccgaaggatcatcttgcaacatcatgttcacatttagcgtcataagctgggttttcttgtctttttttctgttctatgtccatttgggcctctttctaatgtcattacgaggcaaatagtcttctcccctttttcccctcatcattttctgtaattccccattgtgctacattttttcatcttttctttcatttatgctttttggggtggatatcagttactttgttcttgttggtaagtatgttggatcatggtttcttgtaattattactcatgcttttgcttttgctttccacttttgcttttgatgcaacttctcatctgttcagactgagatgtttcagttgcttcttaggatgcttggtgtaattgtgttttcaagtgtaccgatccaccaaactttgtttaaagtttcctggaccttttgaaaaatcagattgagatgtatacctgaagtctaagtttattttgtgaaaaaaaaaaaaaaaaa

SEQ ID NO: 9 - DNA, 3239 bp, Eucalyptus grandis
gcaacaccccccctcctgctgaattttcaacacatcaacatcatattcacgttctcattatgctctgcaagtcgtcgcggaggaccgggacaatagcagcaggaggagccttggaggcaagacgagttctttgacttgtttttctccttggcaagggaaggtatggaggaggccttcctgaggttgatcttcctggtggcggtgcttttgtttgggaaggatctgcagctggttttttctttcaccaatcccgatgactccgtggctctccaatccctcaagatgtcatggcagaacacgccgcctagctgggaaaggtcgagtgacccgtgtggactcccttgggaaggagtaacctgcaatagcaattcgagggtaacttcattgggattatcaaccatgggaatcaagggccagctaattagtgaaatagcaggactcgctgaactaagatctctggacctttccttcaacaaagagctcactggtccgctcgctcggcagttgggcaatctacagaagttgaacatactgattttagccggctgtagtttcaccggtagtattccggacgaactgggcaaccttgcagagctatcattcttggcgctgaactcgaacaacctcacaggcaatatacctgcttcattgggtaacctctccaagctttactggtttgacctggctgataatcaattaacggggcctattccgatatcgacggacacatcccctgggttggacctcctgttaaaagcaaagcactttcatttcaacaagaacaagctttcagggcccattccggaaaagctattcaactcggcgatggttctaatacacgtcttattcgatggaaatcagcttaatggttctataccgtcctcagtaggacttctaccggatcttgaggttcttcgacttgacaggaacaagttatctggaaaggtccctctgaatctcaacaacctgacaaaccttagtgaactgaactttgcccataatgcattgactggccctttaccagacttgacggatatgaattccctcaattacgttgaccttagcaacaacttctttgacccttcggaagctccagattggttctcaactttacctactctaaccacgctggttatagaatatggaccgcttaagggggttgtcccacaaaagcttttcagctttcctcagctacagcaagtgaaattgaagaacaatgaattcaatggtacgctgaacatgggagacaacatcagtccccagttgcagcttgtcgatctgcagaacaaccaaatatcatcggtgacgctgggctcttcgggttactcaaatacactgatgttaataggcaaccccgtttgcactaccgaactctcgaacactaattactgccagctccagcagcagacagtgaagccttattcgaccagcctcgccagctgcggaagcaagtcgtgccctcccgacgaaaggctcaaccctcagagctgcgagtgcgcatttccatacgaagggaccttatattttagaggtccctccttcagggaattgtccaatgtgaccttgtttcacatgctcgaaatggacttgtggacgaagttgaatctcactcccggttcggtttctcttcagaaccccttcttcaatcttgacgactaccttcaagtgcagctttcactcttccccccgagcgggaaatatttcagtcggtcggatattcagagcatcggtttcgacttgacaaaccaaactttcaagcctcccaaaccattcggcccctattacttcatcgcctccccctatgcttttccagacaatggaggaaccgccataagcaaaggtgtgatagttgggatcgctattggcggcacggttctggttcttggccttgttgtattagggttatatgctattcgacaaaagaaacgggcggagaaagctctcgagttgagcagacccttcgcatcctgggcacccagtgggaaagatagcggaggagcgccacaactgaaaggagcacgatggttctcctatgatgaacttaagaggtgcaccaataatttctccgatagcaatgaattaggcttcggaggatacggaaaggtgtacaggggagttcttcctgatggtcatatattagcaatcaaaagagctcagcaggggtcgatgcagggtgcaaccgagttcaagacagaaatcgagctgctttcgcgggttcatcacaagaatcttgttggcctcataggattctgtttcgagcaaggagagcagatgttggtctatgaatatatgcctaacgggacgctcagggatagcttgacaggaaaatcaggcatttatcttgattggaagaggaggcttcgtatagctctaggttcggctagaggactagcttatctgcacgaactcgcgaatcctccaattatccacagagatgtcaagtccaccaatatcttgttggacgaacatctgacggccaaagtcgcggatttcggtttgtccaaactggtatcggacagcgggaaggggcacgtttcgacgcaagtgaaaggcacgctgggctatttggatcccgaatactacatgagtcaacagctgacagaaaagagcgatgtgtacagcttcggggtggtcatgcttgagctcatcactgcaaagcaaccgattgagaagggcaagtatgtcgtccgcgagattcgcaccgccatggacaagaacgaccaggactactacggcgtgagggaaatgatggacccgtccatgaggagcatgggctacctcgtcgggttcagcaggttcttggatttggcgatgcgatgtgtcgaggagtcggctgcggaccgccccacaatgagcgaggtggtgaaggcgatcgagaccatgttgcagaacgatgggatacacaccaactcgacgtccgcatcgtcgtcggcgacggactttgggtcgacgaagggcgctcctcggcatccgtacaacgatgccttacccaagaaggaagttagctatagcgattcctttgattatagtggtggatatggactatctacaaaaattgaacccaagtgaaaaacatgatcaattgatctgctcagtcacttgtttttctttttcctttgtttctgctcaggtttggcttggtcctcttcacaatttctgcaagtgagtaacctgtcttacatgtgtaatagttttgatcagccgcatcaagtgaaggaagttcttgtgcaaaaaaaaaa

SEQ ID NO: 10 - DNA, 2336 bp, Pinus radiata
attcgattcgcgatgctatttccatggcgcagcctcgttctgatagccttcacctccctcgtcgtacaacttattcctgcgcaggccgtggaggatcgtcgacatgacaccactttcctgttcgacggattcaatggaaccaacttgatcttggaggctaatgcttcagtcatcggctctgaatccgtactctcccttacaaatcactcgcatgagttcatgctcgggcgcgcgctgtatgcagctcctgtgcaaatgaaaaacaaccatacggtttcctccttcagcactaccttcgttttctccattgtgcctcctccctctaacgaagggggacacggattagccttcatcatgacgccttacacatctccgatgggcgctcagccggtccagtatttgggcttgcttaacctcaccagtaacgggcagccatacaatcatttattcgcagtggagtttgataccatcatgaatgtagaattcaaagatccagaccgcaaccacgtgggcgtggatatcaacagtctcatctcagtccagacagagaccgccggctattggaatggtgaggaattccatgaactcaacctcaggagtggacggaacatacaggcctggatcgattacgatcatcttgagagcagtctcaatgttaccattacggtggccgggttgccgagaccgcagaggccgttgatatctctgcaaatcgatctgcagaatattgtagaagagaagatgttggtgggcttttcagcggcaacggggctgttagtggaagaccattacattctcgcgtggagcttcaccaccgaagacacggcgccgcctctcgatgtttcttgcctctcttcatttgccaacatgtattccgaacctctgagccggggattcatagccggtgtcaccgtggtttctgtggttcttttctggctggtgattgcggcggccatgtttctgagaagaacactaaacagggaaacggtcgaagaatgggagcaggagtactggccccatagattcgattacaaggagctgcgtatcgccacgcgagggtttcgggacgaaaaccttttggggtacgggggatttggcatggtttacaagggttttctccccaggagcggccaagaagtcgcagtgaaatgtataacgacggagttcaaggaaggaataaaggggtttgttgcagagatctcaagcatggggcggctacagcaccggaacctggttcaactccgaggatggtgccgaaggcatacacagctattcatcgtttacgactacatgcccaacggaagcctgcataaactcatcttcggtagtccgacaacagtcctgccgtggcatcggcgatacgcgatcctaaagggcgtagcagcggggctgctgtatctgcacgagcaatgggagaagagggtcgtccacagggacattaagtcgagcaacgtgctgttggattcggagttcaacgggcggcttagtgacttcgggctcgctcggctgtatgatcacagtgagaatccggagacgacatatgtggtaggaacgttggggtacatagcaccggagttgatacaaacggggaaggcaactcctagctcggacgtgttcagcttcggtgttctgctgttggaggtggcttgcgggaagagtccagtggattcgttggaggactctgagcgcatgattttagtggagtgggcgtgggagctctacacggaggggaggttgctggaggcgtcggatccgaagctggccgcaaagggtggatatgatgaaggcgagatggagaaggtgttgaaattggggttactgtgttctcatccagagccggagagcaggttgagcatgcgccaggtttgccaagtactgaacggcgaagctccagttccttgtagatggtagggacggggcaattccggaggtcaggattatccatgtttgattaaagaatataatacttttatttattatatattattttatgttcccatgcgggcccagcgaggacactgctattgttgctggtcagtggttcaaatccgggaaagagagcatgccgttactcaagttattgctagctatgcgggggatttaagtagtagtctactgttacaaaacatagatctgccctatctacttcctgtgacaaagcagagttgaatgctcagagagcaggaatttgaaatccaaattcctttgtattaaacattttagttaattttatgatgcgtaggcttcatttgtcaccgtattcgattcgtaaagggcgacactaacaataattttataatatttgtaaaatttttggtgttaaaaaaaaaaaaaaa

SEQ ID NO: 11 - DNA, 3097 bp, Eucalyptus grandis
tttgttctcttgcaatgccatatatacacctgaaattctgatcgctctcactcatctgtcgcattcaaagcctcaaagccgcttgtttcttgaactttgccttggcttcaaagaagaaagtcctcaaatagaagatcgaccatatgggactgaagatattctcagtcggctttgctcttctttgttgcttctgttcacttggcttctgtgatcaagacggttttctgagtttagcttgtggtggaactaccaattacacggattcatccaacatctggtggattaccgacagtgatttcataagcacaggaaagactacctatgttgacaatatcgagggcaattcatctggtgtttcgcttcggttcttcccagattccaaagtccataactgttacagattgcctgtgaggaatatatcctccttaattctcgtaagaagccaatttgtgtacaagaactacgatggacgagggaagccaccggcattttctgtttctcttgggacagcaatggctagtactattaacctgaccactaatgatccttggactgaagaattcatatggccggtcgacaaggacacactctctttttgcttgcatcgtattcggaacggtgggactccagtaatttctttgctcgaagtgcggcctcttcctcctgaagcttacaaaagtggaatgggggattacccgaataagttactcaggaagtcttatcgaattgatagcggttacaccaatggctcgttgaagtaccctgcagatccctatgatcgaatatgggatgctgataagagcttcacaccattccatgtgactactgggttcaaaattcaagtcgagtttaatctctcggggctctcggagagtcctcctcccgctgttcttcaaactgccagagttttggcacgaaaagaagtcctgacgtataacttccctctcgactcacttggcgactattacgtcgtcctctatttcgctgggatccttcctatttccccatcttttgatgtgataattaacggggacatagtgcaatctaactatacagtgaaaacctcagcagccagtgctctatatgttacgaggaagaaaattaagtcgctgaacgtgacgttgaagagcaaacgtttctttcctcaggttaatgcaattgaggtgtatgaacttgttgacattcccccagaagcttcatcaaccacagtttcagcacttcaggttatcgagcagtttactggcctggacctgggatgggaagatgatccttgctcaccaaaaccgtgggatcatgtcggatgtgaaggaagcctagtaacatcactggatctttcagacatcaatctgaggtctatcagtccaacatttggggacttgttggatctcaaaacactggatttgcataacgcgtcacttgctggtgagatacagaacttggacagcctgcaaaatctcgagaaattgaacctgagtttcaataaactgacatcgtttggctctgattgggagaacttgattagcctgcaagttctggacgtccaaaacaacagcttagacggagttgttcccgacggcttgggagagctgaaagaccttcacctactggacttggagaataacctgctacaaggtaccttaccagattccttgaacagacagagcttggaggtcagaacctcaggaaacttgtgtctttccttctccacaaccgcgtgcggtgatgcatcatctagtccttcaattgaggcaccgcaagttacaatagttcccgagagaaacaaagggggacataatcgtttagccattatactcggagcagtcggaggagtatcactagctattttactcatcccgctcttcgtattcatgtacagaaggagaggaagaactgaaatgtcatatacggaaagggcagtcgcagacgtgagaaactggaatgcagctaagattttttcctacaaagagatcaaaacagctacaaacaactttaaagaagtcattggtcatggaagttttggatccgtgtacctgggaaaccttccagttggaaaactagttgctgtgaaagtgcggtttgataaaacccaacttggtgcagattctttcataaatgaggttcgtctcttatcacaagtccgccatcagaaccttgtcagtctggaaggattttgttatgagtcgcagcgtcagattttagtctatgaatatctaccgggtggatcactggctgatcaactgtatggtccaaacagtaggaaattctcactaagctgggttcgtagactcaagattgctgttgatgctgcaaaaggactggactatctacataatggaagcaatcctcgaatcatacaccgagacatcaagtgcagtaatatactattggacaaggagatgaatgcaagactttgcgactttgggctctctaagcaaatgatccagccagacgcaactcacgtgaccactgtcgtcaagggcacagctggttacctcgaccctgaatattactccacccaacaacttacagagaaaagcgacgtctatagctttggagttgtgcttttggagctcatctgtggacgagagccgttaaatcattcaggaactccagattccttcaatttggttttatgggcaaagccctacttgcaggcaggtgcatttgagatagtggatgagagtttagggggaagtttcgatgtggaaagcatgaggaaagtggcaaaaatcgctgtgaggtctgtagagagggatgcatcactaaggccaaccattgcacagatactgtctgtgctcaaagaggcttacagcattcagctctcttatcttgcagcctctggacatgtgaactgaatctactcgtattacaaccaagacaagatttttttcttttcggcccaaagagataaaaagaggtcgtttgtcctgataacaaggctgtttatcattcgtttgagtggaacctatgtacagagagagttttgggtgcaattatcatatttatcgtacttaaatgtatgatactgttttatttcatattcatttgtgcaagagaaattaagcaagtttttgttcctaaaaaaaaaaaaaaaaaa

SEQ ID NO: 12 - DNA, 2649 bp, Pinus radiata
gttggaagaccctgtaagcatttggcttccatattgctatttggcaaagagagaaacatgggttgtcggaaagctgtgagatctgtgagcccacagaacccatcttcctctctgatgcatctcagactgttaggtgttttgctcatgcttcattgcattgatgggctgatcctaaatcctgaagtttctactcttctcacactgaaaccaacgttgtctggaacaggggttaacgttgtactggcctcgtggagtgcctctcgccctctgtgtggatggaaaggagttatgtggatgtacaatggtatacctgtcaactgttctgttcccaaatttaggcacagtgtggctttggcttacagtcgcaaggtctcagtgctggggattgatttggaagcaacagggttgaagggtacagtcccaaaggagttgggctcctttatatatctgcagcagctgaatctgaataacaatagtcttacaggagggatgcctccagagttgggaaatgtgcctaatttgagcagtctgcaactcaagaacaatgggctgaatggaggcattcctactgctatttggaatctgtgcgataacattactgagctggaattgggattcaatgagctatcagggagcatccctgaacccggaaatgggtctaatataggttgcccacaactccggagatttgaggtgaataacaacagtctaacaggtacaatccctagcttccttgctaattgtatttctcttcaagagcttgatttgagtgggaattctttcaccggcgaaatacccaatgagcttgcaaatctgccaaacctgacaactctcaaccttgcccacaacaatctaagtggtcgtataccgagttttcggcagaaatttgataagaattcctttgtagaaaatagtggatccctgtgtgggcagcctctgttaaacccatgtggcgtagctccaaatgctgctagtgctgcttctgcaaatgtgactgcagcccagttcaatgtgaccaaagcccatttcaaatctatgagcactggagctattgctggaatcatcattggatcaattgctgttgtagtcattgccagttctttgttaattggatgctaccataggttcagcacagatgccactgacaagtcttcgtcttcgtctgccccttcgaagaaagataaggaagaagacatggacaatgtgagtgggaaattaataaacttccaaggaggtgagcatttgaccgtggatgatgttctgaatgcaacgggagaagtcttgggcaaatccagttatggaactgtctacaaggccaggttaagtagtggttgtatgatcgcactccgtcttctccgagatgggtgtctcagaagcacagacgaattcatgcctgccattcaggagttgggtaccatcaggcataagcatcttgtttctctaagagcattttattcagggacaagaggcgagaaactgcttgcctatgattaccttcccagaggaagcctcgcagaattgctacacagtacaaacaggcctgctcctggatgggctagaagacataaaattgctctgggagctgctagaggtcttgcctaccttcacactggattccacaaatccatcatacacggcaatatcaagtcaaaaaacatacttgtggatgacaattatgttgctcatctttctgactatggtcttaacaagctaatgaactcaacagcaaatattgagatgttagaagctgctgcttcccagggatacaaagcacctgaacttatcaagatgaaaagggccaatgcaaagactgatatatacagctttggtattggtttacttgaaattctcacaggcagaagacctggtagaacaagctcatccaatcatattgttgatttgccaacagtcgtgaagaatgcagtgcttgaagagaggatttcagaactctttgaccttgagcttttgcgtgcaatgagaagtccagcagatgaaggtcttctgcaagttctgcagcttgcaatgggttgttgtgctccttctccatcagtcaggccacatataaaagaggtagtccgtcaacttgaggagattaggccaaaacctcaatctccgcatcttgccctttccccacaatacaattcagatgacaagagtagtagggagtttttgttggatggcggacaaaattaaagatggaatttactcgtctttcctccctagttccgacacttatttaggttctacatatgctataaactactaccgtagttacagatacgggaacatattaagggatctatttttcttttcttgcaagatatgtctcagattataatttatgcccattgggaggggctttcttttgtcagatcatttggtgttctgagaggctgtaagagaaacatcaatttagtcccctgcttctgtacgatttcctatttgtaaatcatactgatagttgtgaggactctcagtttctgtttgtgtttttcataccagagtagatttccttttgttgtcaaagtcatgacatagtaaaaatcatgacaaaaattgacatgtagacgtgtaaacttagtggtaaagatatgcttatatgtatatgaaggatatgcacttgcgtttaaaaaaaaaaaaaaaaaaaaa

SEQ ID NO: 13 - DNA, 2513 bp, Pinus radiata
gaaatgaagatttgagttctccggaaacacactaaggatatcgtagctctttgaaaatgggaaagaaaattttgcaatgtttgcggttaattattgctatattgacggcgtctattgcgatatcgcacggaactacggatccagacgacgtttctgcgctcaaaggcatatatagcagtctaaattctccccagcaactttctggatggagtgcaaatggaggagatccatgtggtcagtcctggaaaggggtttcatgttctggatcatcagttacattaatcaagctctcaggcttaggattgtcaggatcattatattaccagctttcagacctttcatcattgacaaccttggatttgagcaacaacaacattcagggcaacattccttatgcacttccacagaaactccaggagttaaaccttgctagcaatggcctcagtggtactataccgtattcaatttcgaacatgactggcctcacagatttgaagttgagtcacaatcaactttcaggtcagatccaagatatatttggacagctttccagcctctctactctggatctatccttcaatactttgactcaaaatctgccccagagtttcagctcattgtcgagtctcagtgtgctatatttgcaaaataatcagcttgctggttctgttaatgttcttgccaatctgccactcacagatttgaatattgaaaataaccgttttagtggttgggtacccaatgcctggaggtccaaccaaaactttaaatatagcagtggtaatagtttcgccactggtcctgctcctcctcccccaccatatactccacctccaccttctaacaatcggccacccaagtcctcaaatgtggtcccttcatcaggtggctcaaagggtgggaacagcaataagaaatctctgagtggtggtgccatagtgggtataatatttgcagttattttgactgttgttgctgctatattaggagttattttatatgcacgtaagtctcctagaagagagcaggatgaagaaaaactaagcaatcgtgtgtctttcacccccctatctcccctcgatgctgaattattgaaagagagtccagagcaaaaagtcagctcatcacctcttgaaatcgctcttaagcctcccccttctgaacgcaacaagtctacaggggacaaaggcttcggaagtattttttcaagtaagaggactaaaaacccaatatcagcaactgaatattctattgcagacctgcaaatggcaacaaatagttttagtcaagataatcttattgcggagggtgctcttggacgaatctaccgagcagagtttccagatggaaagattttggcagtgaaaaaattggacacttctacgctgtccctacaaaggcctgaagacttcctggacgcagtatctaatatatcgcgcctacatcatcctaacattacagaactagtgggttattgcacagaacatgagcaataccttcttgtgtatgaatatttcgacaatggatcactctatgacgtattgcacatggcagatgagactactagaaatttgtcttggaacattcgtgtaaagattgcgctgggttcagctcgagttttagagtatttgcatgaagtttgctctccatctattgtgcataaaaaattcaagtcgtctaatattttgcttgatgatgatttcaaccctcgtctgtccgactgtggaattgcggccctcaatccaaattctgagcgtcaggttcaggtgctgggttcatttgggtacagtgctcctgaatatgtcatgtcaggaatctatacaatgaagagcgatgtgtatagttttggagtggtaatgcttgagcttttgacaggccggaagcccttggatagttcaagaacaaggtcagaacagtcattagtaagatgggccacccctcagcttcatgatattgatgcattggcaaagatggttgatccagctttgaagggaagttatcctgcaaaatctctctcgcgctttgctgatattattgccctctgcattcagcctgaaccagaattccgtcctccaatgtctgaagtggtgcaagcattggttcgtatgatgcaacgggctagcctcaataagaggatgacaggagatgaaactgcagaccacgatcctgcagattattaaatgcagtgatattgctttggtggtactccagaagaaaatatttaattctaaaaagctcgtaccgccttctttggactttccaaaacagttgaagagttgataacttcattatttagctcctaaggccttcgttggacttccacaacagttgaaagagttgttagcatcatccttcgttggacttccacaacagttgaaagagttgatagcatcattattttcataaattgaatctgttcaagattttttttagtccacgttgtggtgaaaacaatgtaattggaatattaataaaatattaatactggtttgctcaaaaaaaaaaaaaaaaaa

SEQ ID NO: 14 - DNA, 374 bp, Pinus radiata
gttaggggtttaaaacctgaggaggctgctgtgtagggtcgagtttgagcttgctggcggacgggagggggcgaggctcataacacaatgcgacacaatgcgggttggatgtctgtcaagggttttaaagcctgaggaggctgctgcgtagggttgagttcgagcttactcgaggacccgagggggcgaagctgatgatgaggcttggagtgtgaatccgtggatgttttagcgggacgaaggatcgagtctcgtccgtgaggggaaatcaggcagttgaaacaaagaggtgaagaaatttgcagcagagtcatgcagcagccgtatgtagtactggccctgtggtggatattggtactgcgtcacccgctctg

SEQ ID NO: 15 - DNA, 490 bp, Eucalyptus grandis
gtctaaagaagcttgagggatagacaagccaaagtaagagagatagagagaaccagttgatccaataaaggtcagatttttatgctttgctcacacacacccatctgaagctactttgtgtcatgtcattcccctatccttctcctcaaacccagcaacatacaattgctttgtctaaacactagtggtctatgtctgaaagcaacattttctttgagaatcaatgagggtcctattcattgttctgggggttgtacttctgtgcactgtaattcctggttcatcttcttctgtcagtgatgttgatgtcctacttgcgctgaagcaaggattccagtcccctgaaccggctttaatcacttggagttcttcaaactcgagctcagtttgcttatggtatgggattagatgctcaaggggacgcgtggtttcgctccagctgacggatttgaatctgggcggctctgtctcccctcctgtttcaaggctc

SEQ ID NO: 16 - DNA, 468 bp, Pinus radiata
gtttttctcatgctgctgtgctttgtgctcgttgcagggacctctgctgctgtagacgatcatcaatatctgtatcatccttctcattatgttatgaatgagcgccaggaatctggaagctccatggcccgccacgagaaaagggatgtggaagctcttctctccttcagaaacgccataacggccgacccacatggattgttgtccaactggacggcccacaactctgccaacatatgctcgtggaatgggatcggctgcagaaaacagagcagaagagttgtttccatataccttcgtttctcacacctagaagggacgctttcgccttctgtgggtaatatctctttactgcacaccttcgtacttactgtcaataaattgacagggagaattccgccagagtttgggcaacttaaagccctccaaacgcttgacttgtaccgtaatcttttatcaagttctggt

SEQ ID NO: 17 - DNA, 518 bp, Pinus radiata
atagagtgagaaatacagagcctaatctgaaggaagttggagtgatagagtgagaaatggatcttcttcttctcctgcttgtgatgatgggtgtagcaatgcctactcattctcaacacacgggtggattcacttctgttcaacgttttccttttaatggacggagtatgatggggaaaccctccatagccgggtatcatgaaaaaagggatgtggaggcacttctcagcttccggaagggcatcacattggatccatatggatggctctccaactggacggccaataactcacataacgtctgcctgtggaacggaatttcgtgcagcccaaacacgaatcgagtggttgaaatttctctccgttacggccggttgaatggtacgctctccccgtatattgggaacctctctcttttgcggcatttagatctttcttcgaatgctttgagtgggagaattccagcaaaatttgggcagctgaaagcgctacgaatacttgacctctccaataatgct

SEQ ID NO: 18 - DNA, 630 bp, Eucalyptus grandis
tgggtctctctctctctctttctctgtgtgtctcggtccttgtgctcgcgggctgtttcgctttaccctcctctacttcaccgccaatgacttgcggagagatcattctgggtctgtgcctgtgacgtcccttcttgggattttcgtgcttcattcttctggtacactcctcgtttgtaaaatcccggttggcgagctgggtggagtgtttctttgcgttttgtggtcttttaggctcttgggtcgtcgttgttttggccattgaggccgtttcttgtccgtttcctgggagagtgaggtgcgcagacgagaacggaaggaaaaaggtgggaactttgaagcgtggactgtacggagcgtcgtgggctctgcgaaattgaagatggttttccgacgattcgtggtgatgctcttcatttgcacggcgtcggtctgcgctggcctcactgatcctcgcgatgtggcggcaatcaatagcttgtatgtttcactgggctatccgcctctacgtgggtggttacttgttggaggcgatccctgtgttgacaattgggaaggtgtcgagtgtgttatctcaaacataacgggactaaatctgagcggagccaatttgggtggagaattgggcga

SEQ ID NO: 19 - DNA, 385 bp, Eucalyptus grandis
ggcagaaatcctaagctaggcagagtctccgacgataccaaacgatttatagttcctgcttctcttgtttcgtgatgggtttcttctaccaagtctttctcatatttctggcggtcgcgccgtctgctctgtgccaagttactgagttcgtcagcatagactgcggaggatccagcaactacacagacccgacaacagggctcgcatggatcccggacacgggtctcatgagctatggccagtcttcgaaggtgcagaatcccaacgtaagctcggtgcagtattcgacgcgcagggacttcccaatagacggccagaagtactgttacaccctccggaccgaagagagaaggagatacatcgtccgtacgacgttcttgtacgg

SEQ ID NO: 20 - DNA, 496 bp, Pinus radiata
ctctcctcgtctctgcatttcaagcaccatggcgtttccatgtttttattttcctttccgtatcttgtttttcctcttcgtatgctctttttccttctccttctccttctctgcgcacaaatttcatgacggtcggaaatggctcttgtcattcaagatcgatattaccaatgatcctcatgcttccatggccaactggagtcctgcagtccacctgtgcaactggactgccgttacgtgcagtcgcaggcacgcagatagggtggtctctctcgacctaagtggcatggatctgagcggctccatatctccttccctcggcaatttgtcatttcttcatacccttaatctcagtgccaatgctctccatggtcatattccaccacaactgggacgcctctttcgtttgagaaacctctggttacgcaacaattttctgcaaggaaatatccctacagagttcgcctccctcaaacatttgcaacagctttacttg

SEQ ID NO: 21 - DNA, 352 bp, Eucalyptus grandis
gagaactgaactgacccagagacccactttttctctcatcatcatcccttcaggatcatgagattttcgtctctcaaaagaagaaggtggatcatgaggacagcaatcatcattaccagtctgatgtgttgttcttccgctagagacagcatgacgctcagcagcccgctcagcgatgagcacggagacactctggtttctgatggagggaccttccaacttggcttcttcagccccaacggaagctcgggctctgaccacagaaggtaccttggaatatggtactacgactccgacccgcagaccgtagtttgggtagctaacagagaccaccctgtgttggatgtgactg

SEQ ID NO: 22 - DNA, 635 bp, Eucalyptus grandis
ccggtctgaaaaccgacacttttgagtgagaaccggttccttttgcggagttttggagggacgggaagtgtaatggggctcgcacgtttgctcctggttggcttcgtcctgctcgtgcttggctcgagagcgctcgtgtgcgggaatgcggagctggaggcgctcatggagatcaaggcctccttggacccggagaacaaggtcctcacttcgtggaccagcaatggcgacccctgcggcggctcgtttgacggggtggcgtgcaacgagcatcagaaagtggcgaacatctcgctgcaagggaagggcctgtcggggaaggtccctcccgcagtggctcagctgaagtgcttatcgggcttgtacctgcactacaattacttgaccggagagattccaagagaaatctctagtctgaccgagctgacagatctctacctcgacgtgaataatttaactgggagtataccttctgaaattggaagcatggctagccttcaaggtgagttttgtttgttgctccaagggcaggggtgaatgctttcttgtgtatgatttcactcccaagggtaccttatcgcaatatcttgatttagaagatggaagcatccaggttcttgattggtccacaaggg

SEQ ID NO: 23 - DNA, 580 bp, Eucalyptus grandis
cccaggagacatcacccattttcctaagtattaccagatcaagagaataacctgaagctgtgttctttgctactccgcatccgttattttcttcggactctgctccgatgggagtgaagagagcgaattcctctctgtgctgcgtggttttgctcggcttgtgggcttgcgtacatgggttgctctctcctagtggtgtcaatattgaagttctagctttgatggacataaggaatttgctagtggatcctcatcaagttctgaacaattgggacgcaaacgaggttactccttgtacctggactgcgatcacgtgtgaggctgatgtcgtcactaatctagaaattccaagacagaacttatctggaacgctttcgcatagcattgggaacttgattaatcttaaatatttgttccttcaggacaacaacatttcaggatttattcctcccgagcttgggaagctccagaaacttgaaatgctcgacatttccagtaactcattctctggtgaaattcctaccgagctatcccatctcaagaacctccaacaactgagaatgaactacaataacctttc

SEQ ID NO: 24 - DNA, 457 bp, Eucalyptus grandis
ctcacctcccaaagaccaaacatccccaaaaatcatggtttcttccttattgctgtccagccagcctaatttagtggtcggcttcctcttcttgctcctcttagttgacaccactccatttcacggagcaggcgatatggcttcctccacttcctttttcaccatcaacatgaccaagagtaaggatgaagtagaggctctcttgaattggaaatctactcttgacaactatagccagtgtctcctctcttcatggcatgacaacaatccttgcggctttagcggtgtcacttgtgacgactccaaagctgtcaacaatctaaatctttccaatcttggtttgagaggaactctagacggtcttgacttctcgtgcttaaccaatttggttacctttgatctttcctacaacgcaatctatggctccatcccctcaagtattggtaacctttccaaa

SEQ ID NO: 25 - DNA, 481 bp, Eucalyptus grandis
ggaagagtgtaacttcttcttcttctccatttgaattgtttggcgctgtttacagatgaagattggagtgacgagacacatctttttgctgaggaaggagtgtgaaggtgcttcaatcttccccagaagccggggaggctagaagagctgctcgttcttcttcgagcctaactattctccaagtatattgctgtgaactggctgtagaaaatggaagggaagcacctcgtttttctgacaattctcttgttggaatcgatttgctcgaatgtctcggcgatacccaacgaggataagcaagcattactggattttcttggcaatgtttccctctcgcgccctctcaattggaacaaggattcttctgtgtgccggtcctggacaggggtcaagtgtaataacgaccaatcgagggttgtcgccctccagttgcccggagtggggatcaaaggtcgaataccgccgaacacactgagtcgct

SEQ ID NO: 26 - DNA, 648 bp, Pinus radiata
tgattccattgcgctgaaaccaagaactctgtctgtctgatcaggctgtatcatggcctacaagcttttgagattttggcttgaatttcaggccttactagtcctctttccattggctctgagtgtctctcaggagggcttggttttgctggaagtgaagaaagaactgagtgaccccaatggatttcttggtaactggaaggcagaggacgattctccctgcaaatggaggggtatctcatgcgaccagaggtcaaaatcggtggtggggattgacctaagcagcggaggtttagttggggtttttcctagtgtcgtttgcaatcttccacagctgaaaaatctgtcgttgggggataacaatattggctcaatattacctcgcaacctttccatgtgcaggcagcttcagcgcttgaatttatcgcagaatctttttgtggggaaccttccggactttatttcagagctcgcagagctggaatacttggatctctcgagtaacaatttctctggttcgattcctgcaggcattgggaaactgccaaggcttcaagtactgaacctgtgctgcaatctgctaaacgagacaatcccaacatttctgggaaatctcagcaatctgcagcaattattgctggcatacaa

SEQ ID NO: 27 - DNA, 427 bp, Pinus radiata
atacattagttctgcaaatcaagaatgggatcgtcggcctccccttttatggtgttgttactcctttccactttgattcttgaaatattgccaatgtatgttgcaacaaatagaagcgaagctgatctccaaggtctcatagcattcaaggcatcaatcaccagtgaccccttgaatgctttagctgattggactgcttctgctcatcactgtaattggtccggtgtggcctgcgatcccctccacaacgttatctccattagcttaccagagacacaaatccaaggcctcatctctccgtttcttgcaaatatatcttatttggcttcactagacctcaggtccaacttcttccatggtgtcattcctccgcagctcgctctgtgctcccaacttatcgatctggagctctttaacaattctttga

SEQ ID NO: 28 - DNA, 516 bp, Pinus radiata
gctgaacataactgttttgcccattctgattttgctgaagcaccaaggcttcataagagcaaaatggaagtacggatgataaccataatgatattatgtgctgctttactatgtgaagggagcggagaggtggatgttctgatggagatgaaagctgcattggaccccaagggggagatactctactcttgggtgaagggaggagatccctgcagtgggacttttgatggagtggcctgcaatgagcaaggaaaagtggctaatgtttctctgcaagggaaaggattatcaggctcaataccctcaaccattggcaagctcaagtgtctcactggactttatttgcattacaacagccttggaggggagatacccagagagctttctaacttaactgagctgctggacctttatcttaatgtcaatgggctctctggtcccattcctaaggagctgggagccatgtccagcttgcaagcactccagctgtgctgcaacaagttgacagggcctata

SEQ ID NO: 29 - DNA, 418 bp, Pinus radiata
ggaagttggagtggtagagtgagaaactgacagcctaatctgaaggaagttggagtgatagagtgagaaatggatcttcttcttctcctgcttgtgatgatgggtgtagcaatgcctactcattctcaacagacgggtggattcacttctgttcaacgttttccttttaatggacggagtatgatggggaaaccctctctgttcccatcctccatagccgggtatcatgaaaaaagggatgtggaggcacttctgagcttccggaagggcatcatatcagatccagttggatcgctctccgactggacggccaataactcacataacgtctgcctgtggaacggaatttcgtgcaggccaaacacgaaacgagtggtttcaatttctctccctgaatgcttgttgaatggtacgctct

SEQ ID NO: 30 - DNA, 468 bp, Pinus radiata
catgagggagagagagaccaaggtctgtatcttcattttctgtattttcacatcatgggctctggtcgattttggggttcctgcagtttttgcagcacaagagactcagatacaaatactcctgaggatgaaagaggctctggaggatcccacaaatgcactcagggattgggatgggtctgaggattctccatgtagatggagagggattgattgtaacgatgaaggtgctgtgactcgcatacaactccatggaagttctctgagtggtcgcattctgcctgatatctgcaatctccagagcctgataatctttgagctagatcgaaattccctttatgggaatttccctccagaattttcgaattgcagtcggttggaacaattgaatttgagctccaatttgctgaacgggtcattgcccgacctttcaaaattgaaggctctgaaatatctggacctgtctaa

SEQ ID NO: 31 - DNA, 409 bp, Pinus radiata
ggcagttggagtggtagagtgagaaatacacagcctaatctgaaggaagttcgagtaatagactgagaaatggatcttcttcttctcctcatcatgatgcttgtgatgatgggtgtagcaatgcctactcattctcaacgttttccctttaatggatggagtatgatggggaaaccctctctgttcccatcctccatagccgggtatcatgaaaaaagggatgtggaggcacttctgaccttccggaagggcatcacattggatccatatggatggctctccaactggacggccaataactcacataacgtctgcctgtggaacggaatttcgtgcagcccaaacacgaatcgagtggtttcaatttctctccgttacggccggttgaatggtacgctctccccgtata

SEQ ID NO: 32 - DNA, 518 bp, Pinus radiata
gtagagtgagaaatacacagcctaatctgaaggaagttcgagtaatagagtgagaaatggatcttcttctcctcatgatgatgcttgtgatgatgggtgtagcaatgcctactcattctcaacgttttccctttaatggacggagtatgatggggaaaccctctctcttcccatcctccatagccgggtatcatgaaaaaagggatgtggaggcacttctgaccttccggaagggcatcacattcgatccacatgaatggctctccaactggacggccaataactcacataacgtctgcctgtggaacggaatttcgtgcaggccaaacacgaaacgagtggtttcaatttctctccctcagcgctcgttgaatggtacgctctccccgtatattgggaacctctctcttttgcagcaattagatctttcctttaatgctttgagtgggagaattccagcagagtttgggcagctgaaagcgctacgaacatttgaagtccgccataatgctttgagt

SEQ ID NO: 33 - DNA, 401 bp, Eucalyptus grandis
gttcttagatcctgaagaacctatggcgtcttgcggtggccttgtgtctaccttcttgttggcaatctttgtcactcaaattgtcgaattcagtcattccattgcttcgacaaatgtaagttgtattggtgtggagagggaagctcttctaaagttcaagcatggtctcactgatccttggaaacgcttgtcatcatggactggtgaggaatgttgcaagtgggaaggagttgaatgtaacgagaagacaggccatgtcctcaagctcgatcttcataatccatgtattgaagagattgatatgcttgaaccttcatataagtgcaggttgggaggtaacatagttcattctttaacagaactgaagtatctgaagcacctggatcttagcatcaacaact

SEQ ID NO: 34 - DNA, 434 bp, Eucalyptus grandis
ggagaacccaacattgctttctctgccactctcactctccttctttcaatgtgttccagaagagttgtttcttcaatggagaccaacccaattcatctaatctaccatgtatttttcatcgtcatagggcttgtctctgtttctgcagccgaacagagtgcttcctccaggaaaacggatgcggaagccctgatcctgttcaagaaaatgatccagaaggacccgagtggagtgctatctgggtggcagctcgatcaggatctctgcgcttggtatggagtcacatgttactcagggagggtcactcaactcgatcttcacggccaaagtcttgaagcgaccatgtctttcgaccctttgagttctttagacatgttaactgtctcaatctgtcatcaaactcgttcgccatcgattcaacttccttgcttcaa

SEQ ID NO: 35 - DNA, 442 bp, Pinus radiata
ggaagttggagtggtagagtgagaaatactgaaggaagttggagtgatagagtgagaaatggatcttcttcttctcctgcttgtgatgatgggtgtagcaatgcctactcattctcaacgttttccttttaatggacggagtatgatggggaaaccctctctcttcccatcctccatagccgggtatcatgaaaaaagggatgtggaggcacttctcagcttccggaagggcatcatatcagatccacatggatcgctctccgactggacggccaataactcacataacgtctgcctgtggaacggaatttcgtgcaggccaaacacgaatcgagtggtttcaatttctctcccttactgccggttgagtggtacgctctccccgtatattgggaacctctctcttttgcggtatttatatctttcaaataatgatttgagt

SEQ ID NO: 36 - DNA, 493 bp, Pinus radiata
gctgctcggcactctcagacgaagttacgaaccatgaggtccgtgtttcgaatctcgtcccttctcgtgatttctattctggttctgctcacgctttcttccgccattaacgacgatgccgagatgctgctcgcgttcaagtcagccatgtcggatcccgacggcgccctggccgggtggactgagtccgacgccgccaatttctgtgggtggactggagtcctgtgcaacgaattcaacagaacgagttcgctggacttgaccaacatgaatctgtcgggcatcattccgccccggacattatcgagcctcgacagtctcgtgaatctcagcttggcgctcaacaaattcagcacgccgttcccgtcggcgatcctcgacatttccactctgcgattcctcaatatatccaacaataacttcagcggcgagatcccggcaaacatttctcggttagtgaatctggagttgctggacacctacaacaacaatt

SEQ ID NO: 37 - DNA, 536 bp, Pinus radiata
ggagaagctgctgctcatggctcccctgctgggaattctccttcttcatgctctcatttttagctatggagaagaagctcacgtcgctggttcgaaccacacagaggttcgggcactcatggctctcaaggccgggattgttgacacttcaggtcatctgagtgactgggaagtccatggcgatgaacttagtgcttcgccttgttcttggactggtgtgttttgtgatttggagtctgagaacgtgacggaactcgatctctcacggatgaatctcactgggacgatttcagacgagattcgggagctgcagcacctgaaagtactgaatattagcttcaatcagttttccggggcctttccagttgtaatctttaatctcaccaggctgcggagcctggacataaatcacaactctttcgaagggtatttcccggccgggatctcgaagatgaagaatctagtgaattttatagcttttagcaatagtttcaaagggcctctgccgctggaattcgtggagatgcttttctgga

SEQ ID NO: 38 - DNA, 822 bp, Eucalyptus grandis
ctctctcttcaccaccactcctcctcccctcaccttaatctctcctccgatcccacaccaaaacccccgccccacctccatggcggccccctcctcctccgccgcctccgccgccgtgttcgccctccactcgctgctgctgctgctgctgctcgccgccgccgtcgaggacgacgtgctctgcctcgagggcgtcaagcgctccctcggcgacccccagggttccctcgccgactggaccttcgccaacacctccgcctcccacatctgcaacctcaacggcgtcgcctgctggaacctcaacgagaaccgcatcatcagcctcagcctcaccggcttcggggtctccggcggcctccccgagtccctcaagaactgccacagcctccagacgctggatctctcccagaacaagctcgacggccccatccccgcccaaatctgcgagtggctgccttacctcgtcaagctcgatctctcctctaactcgctcgccggccccatccccagccagatcggcgactgtaagttcctcaacaacttgattttgaacgacaacaagttgaccggccccattccttacgaggtcggtcgcctggaccggttgaaggtgttctccgtccggggcaatgatctctccggatctataccgtcggagctgtccaaattcagttccgacgatttctccgacaacgacgatctgtgtggtaggcctcttgggtcgtgtggggggttgagtaagaaaagcctcgctataattatcgctgcgggtgttcttggagccgcagcatctttgttgctagggtttgcgctctggtggtg

SEQ ID NO: 39 - DNA, 454 bp, Pinus radiata
ggagtggtagagtcagaaatggatcttcttctgctcctcgtcatgatgtttgtgtgctctgtgatgatgggtgtagcaatgcctacggatggattcacttctgttgaaagcgttccttttaatggacggaatcgccataaaagggatgtggaggcgcttctgagcttcaaagagagtattatatccgatccatatggatcgctcaccaactggacggccaataactcacataacgtctgcctgtggaacggaatttcgtgcaggccaaacacgaaacgagtggtttcaatttctctccctgagtgctggttgaatggtacgctctccccgtatattgggaacctctctcttttgcggcatttagatctttcttggaatgctttgagtgggagaattccagcagagtttgggcagctgaaagcgctacgaatacttgacctctctgctagtcatg

SEQ ID NO: 40 - DNA, 504 bp, Pinus radiata
caaaccctctgaaatatttttgtaattccttcattttatcgatcgcccatctgaggagccgatggcaccttccacagatttcatcctcatcacctccacactcatgctcatctttgtttctgcaaacgcccatcttcttcatcattatcatgagaaaagtcgtgaacgactgcaggtcgatatagaagccctgcaagcattcaaggcctccctcacatatgatccttctcacgccttggccaactgggattttgtcgccaatcatgtctgcaattggactggtgtcacctgcaaccctcacaaactgcgcgtatctgccctaaatctctacaacatgagcctgcaagggactatacctccacatttgggcaatatctcctttcttggcgtgttgaacctcactttgaacagtttctctggcataatcccaaacgaattgggcaagctgcgtcggttaaaacgtctgtccctcaagcagaatcagttgatttcgtccattccaga

SEQ ID NO: 41 - DNA, 403 bp, Pinus radiata
cattccttctcttctcgtttgtgcaatgagaatgtttctattactcgtttatttgttcccccttgtcactcccttcgcgttttccacagtgcaattatctaatggctctaatgctgtcgatcaagaggctgtgcttggattcctgtctgcaatcactaatgatccctaccaatcgttacccactaactggaaatcaaatgtttcagtctgcgagtggacaattatcaaatgcaatgggtccagagtggtgtccctaaatgtgtcgagcatgggattagaaggtacaatctctcctcttctcggcaatctctcatttctggaaaaactcgaccttcgcaataacaattttcatggtcccattccctatcaattgggaagcctggtgcgcttgcagatgcttatc

SEQ ID NO: 42 - DNA, 595 bp, Eucalyptus grandis
gagagacggcgatggaggatgaggaagaagagacgacgacggcgacgatgatgcgcggaccatgccgatccagagacggcggcgcagcagcggcggcggcggcggcggaggcggcggggccttccaccgtgtgttgatttctctctcccggccctcccgactccgccttcgggctcggcggacttgattagtcgggcatgtgaaaaagaatctttgactgctcagattgttgaacaacgtgatggagtcctgcaactgcgttgagccacagtggccagctgatgagcttttgatgaagtatcagtacctctcagatttctttattgctctggcgtacttttccatccctctagaactcatctactttgtcaagaaatctgctgtatttccctatagatgggttcttgttcagtttggtgccttcatagttctgtgcggagcaacccacctgatcaacttatggacatttgccattcactcaagaactgtagcatatgttatgaccattgcaaaggttttaactgctgcggtatcatgtattacagctctcatgcttgtgcatatcatccccgatctacttagtgtgaaaaccagg

SEQ ID NO: 43 - DNA, 397 bp, Pinus radiata
gttcgttagcaatgcccacttctacctcaaagtgcaggttaaggactctggctgtggcatacagccacaagatattcctcaaatatttaccagatttattcatcctcgaagtggatctaatcgaggtaatggcagcggaggacttggacttgccatttgcaaaagatttataaatctcatgggaggtcacatctccatcgagagtgaaggccacgacaagggcaccatcgtcacttttgtcgtcaaactacagaaatgcagcaatgcaaatgactcggcagcccacgagatcacatctagagctcagtctattcatgaaagcacccattttgctcggcataaacctctcatagacactgacagaacggtcccctccagctcccagtatcaaagaagt

SEQ ID NO: 44 - DNA, 415 bp, Pinus radiata
ataaattctctcaaagagatggtatgcacttatggtccttatgctgccctctgatagtgctcgcagatggcatgttcatgagttggagcttgtggaggttgttgcagatcaggtagcggtggctctctcacatgcggcaattttggaagaatcaatgagagcacgagacctgctcatggagcaaaatgttgcacttgagatagctcgacaggaggcagaaacagctattcgcgctcgcaatgatttcttagcagttatgaaccatgagatgcgtactccgatgcatgcaattattgctttgtcatcgcttcttcaggagacagagttgactcctgaacaacgatccatggttgagaccatcttaaggagtagtaatctccttgcaacactcatcaatgatgttttagatctttca

SEQ ID NO: 45 - DNA, 526 bp, Pinus radiata
atggcgagtccaccctcgactccaacaggtatcaccaacgtagctcgtctcacgatgcgtgctgaagccggtggtgatggtgacagtcacgcccttgccctcggtagcgatccgatcgcgacccaatcgccatcgacgaagcgtcgtgccgcatccgcgccatggccatgggcgtatacgcgtgtacccattgtggcggcgaccgcgggtgcactggaagaagagcagaaagagtgtatccaagcaggtatggatgatgtcttgacgaaacccatcgacaggtatcagctgcaaaggaagctggccaggttctcaccgcgtttcacatcgctcgtagtagcatcatctgcaccagcaagccagcaagcccatcagtgacatgtggcaatatgacatgcacaacagcatattaaagtcctctagttggtcatcataaccagcaatacaaggcaacaacaagcaaatgcatttcaatgtcatagtcactgttacacatcgccaccttgtcccaacttatcaccatacc

SEQ ID NO: 46 - DNA, 255 bp, Pinus radiata
gacaagagtgttgctgattgatgaccatccactgttccgggagggactggcaggtgcgatccaggccgagccagatttcgaagtcgtcggccaggccgggaccgtggacgagctgcgcgggcttgcgccgcagatcgagccggacgtcgcgatcgtcgacctgttgatgccgtcggtctccgggatcggcgtcacccgcgagctgtgcgagctgctggctaggtgccgagtgctggggctgtcggtcttggtcga

SEQ ID NO: 47 - DNA, 3567 bp, Pinus radiata
aggcaatgcaagggcaggcatggaggactttttaaggatcgtgtagttgttaatgatggttcaagtgggtgcatctcaaaattttaaacaattatattgaaggacttttgggactttgtataatatttgactactatgggaaggatggggagaatgcatgaatgtaaactgtagtccattcccctcccaagtatcgagaattctttggatttggattacatttacatgtcattctcatattctgtgggttggcaagaccaggcggtatggaagttgctgtgggtggctgtactgttcattttcattaaaagaatacagaggccaaagtctgtattaatcccacgaagtcaagctcggcattcatattttttcctcctggcatttggttgcggtactaatccacaaatggcaattctgaatatatgaattctttctcttgtggaaacctggaaggacagaaaccctcgatgaggttaagtttggtctgtattcgttgagaggttcttcatctgatatggattggaccagaactggggcacatcatgtttatgttcaaggagaggcaatgggtttggtcgataatccccagtctcctagatttgggtttttgtttcgtgtgaatgtaaatacaaattaagttaagaaattcctttggaaaacccatattagggctttgggcctacatgggtaccattggacaccgatcagaagggcggtttgagtgcgctgtataagtggtttctgttttgattcagaggagcccatgtgtgtgatccgagcagattcaaacgcgtgactttgtttgtgttttttcaaaaggccgctgctccctgttatcacacagttcacatgccgtaaggacttgacgagattgttgcaatgatctgtctgggtgggattgtcattgtttcattcctcctccagaacattgcaatggcatcagaggatgggggttccagatgcaactgtgacggggaaggatggtggaatgttgagaacataatgcaatgccagatggtcagtgattttcttattgccttagcgtacttttccattcctcttgagcttctgtactttttgagctgctccaatagtcttccattcagatgggtcatagttcagtttggagcattcattgtgctttgtgggctaactcactttatcaacatttggacatatggtcctcagtctttccatgtaatgctggcactaaccatcttcaagttcttaaccgcccttgtttcttgtgccacggccataactcttgtaactctaattcctgaattgctacgggtgaaggtaagggaaatttttcttaaaaacaaggcaagggaacttgatagggaggtagacattgtgaaaaggaaggaggaaactagttggcatgtccacatgctaactcaagaaatacgaagttctctagataggcacactattctaaatactactttgatttcactagcaaagacgttgaatttggaaaactgcactatatggatgccactggcagatggtactgccatggaggtatcccatgagctcaaacgacggcatttgcaagtaccattaactgttcccacaaccgacccagatgtgaaaaagattatgcatagcgaggatgcaatccttttaagtcctgattctgccttgggaaaggagagtaatcaccactggtcattagccgggcctgtggcagcaataagggtgcctttgtggaaggcatcaaatttcaagagtggagcatcggtagatagagaagaatcatatgcaataatggtgctagtcttaccttgtgaagatgaaaggcagtggagttctcaagaattatatattgtcaaagatgtggcagaacaagttgctgttgccctatctcatgcagctgttttagaagaatcacagaagctgaaggctccacttattgataagaataaaacattacaacaggcaaaacaggatgcattgagagcaagcaaggcacgacattcttttcaattggcaatgaaccgtgaaatgaggcttcccatgcatgctatttctgcactctcatctattttacaaagtgctagactgaatgttgaacaactggctatgacaaatatgctagctaaaagtagcagccttctctcaactctcataaatgacataatggatttttcagaattggaggatacttctttggttcttcagttacaccccttccagctacatggtatgctgaaagatgcagcacacctcacagagaccatgtctagaagcaagggtcttctattaaatgttgaaataggtgatgggatgcctgaccatgtgataggagatgaaaaacgaattctacggattattttacatatggttggaaatgcaatcaattcaaccaaacaaggaacaatatcaattcgcatctgtgtcgaagacagagctgaaggttggtgggaccccaacaatcgacgatggagaccctcactatgcgaaggttttacatatttaagatttgagatcaggacatctggctctggaagtattcaaaatgacaatcccagtttcctgactgttgtacaagatggtaaaagtgattcgtcatcatcaactggggaaggacttggttttgctatttgtaaaaagtttgtgcagcttatgcatggaaatatttggcttgagcctaactccaagggtgaaggctctgttgtgacctttttaattagagtacaactgcagacatcaactgcaaacaaacattggctgtctccagatgagaagatttacaagtcttcatttaaaggtttgaaagttcttgtagcagatgacaataatgtaagtcgttcagttacgagaaggctgcttcaagagctaggttgtcaaacaactgaagtagattcaggttacaggtgcttaatgactttgcttcagtctggaagtgcatttcaattggtctttctggaagtttgcttggcccagatggatggatatgaggtagccttccgtatacgacagaaattcagatcaagaaaccgtcctttggttgtggctttaacagctagtacagacaaggagaccatggagaggtgccttcaaactgggatggatggtgttatacggaagcctgttacgttaagagaaatgagcaatgagctttttaaaattgtacatcagacaaataacatccacgaatagtgactacaagtgtactttgttctgaggtgcagtccatctggtgaagattgattgctttgacaggttcagaggagtgcaaattatggtgacaatgagaccatgctacacagtcagttacgttggagattcctgtgcttaaattcaaaaggtccatggtcttctccgagtgttaagaaacacggtactttgccatgtacttttttccattgctactaaaatcattctgtcacacacaggttctgtatgggtaattacctcatctcatgcatggcgatgttagaagtcctgggacccatttgacaagtcactgactgttttagctcaattcttacagaagatgaaatcaaaattatattgatatgaagctcatgattctttattgtgatcaaaaaaaaaaaa

SEQ ID NO: 48 - DNA, 476 bp, Eucalyptus grandis
agacgatgcgagcgaaacaaatgctagcaacaatgtcacatgagataaggtctccccttgctggggttgttagcatggccgagattcttgcacaaactagacttgatcatgagcagcggcaattgttagatgtcatgctttcttcgggagatttggtccttcaactaataaatgacattcttgacctttcgaaggttgagtcaggggtaatgaagctggaagctacaaaattccggccgagggaggtagtaaagcacgtgctgcagactgctgcggcatcattacggaagatattaacattggaaggacatgtagcagatgatgttcctattgaggtcatcggagatgttctaagaattagacaaattctcaccaacttgatcagcaatgccatcaaatttacacatgaagggaaggttggcataaatctatatgtggttccagaaccatctgtcgagaaaacagaagaatgtcct

SEQ ID NO: 49 - DNA, 513 bp, Eucalyptus grandis
gtaagattgagattgaggctgtgcagtttgatctaagggccatattggatgatgtcttgtccctcttctcggggaaatctcaagaaaaacgagtggagctagcagtttacatttctgaaaatgttccggagaagttgattggtgatccagggagatttcggcagatcatcacaaatcttatggggaactcaattaaattcacagagaaaggacatatcttggtcacagtccatcttgttgatgaggtgatgaactcaactgatgctgagatggaatcagcaacaaggagtacgttgagcggcttcccagtaccagacagacgactcagctgggcaaaatttaggacattcagccaggaaggccctgcgtctccggtgccgtcatccttctctaatccaatcaatctcattatttcagtggaggatacagggataggtattcctccagaggcgcaaccccgcgttttcactcgtttcatgcaagtgggcccatcaatttctcgaacacatgggg

SEQ ID NO: 50 - DNA, 1995 bp, Eucalyptus grandis
cttgagcataaaatatccatttcttcacttaagacaaagttgaagcaacatggtagtcacgcaagaagggcatccaagaaagacaacaaagtgaccctctggttcgaagttgatgacactggctgtggaattgatccaagcaaatgggaatccgtttttgaaagctttgagcaggccgatccatcaacaactcgattacatggcgggactggtcttggcctatgcatcgtacgaaccttggtcaacaaaatgggtggagaaatcaaagtcatcaagaagaatggcccgggaactctcatgagactttacttactcctcaatgcacctgttgatggcacggaacataactgctcagtggattatgccgtgcacaacataagagtgctactcgcacaacatggaagcacgggtagatttataatgtctggatggctgcgcagaaatggagtttccactctggaagcatctggatggaatgaattgacccagattcttcaggaactctaccaaggcagaaattcaggtgctccatacaggactgttaatacggaacatgcacatgaactcccgagatcagaagtgacaactttcgatgatattcaaagtgagatcctcatcatagtcgtggatatagagctacttgacctaaacacagatatatggaaggaacagctcaatttcctggacaagtaccacaggaaggcaaagttcgcgtggatgctaaaccatgacaccttcaatgccattaaggtggagctccgaaggaaaggacacatgctgatggtcaacaagccgctatacaaggccaagatgattcaaattctggatgctgccataaaggagaggaactctgaactcctgaaaagggcctccaattcttcaaaaagcatgaataaagaagaggacttgcacgagtgtctagaaatcgactctgagcactatgagggagcgagctctgatgaactggacacagttgaaacatcacgttctggttgtaccaatacatctcctggtgaacaaaagcaacaggaagggatcaaaacccctcctgctctacaacacaggacatcgaactatcactcattcaattctactctgctgtcttccgactataacaatttagggaacaaagaagaagcgtgtccaactagtccccctttggaccacccagataatgccgaaggcagattcaagtgcacgaggagcgtgttttcttcaaaagaaaaggaagatggaaattcagaagcacaggaacaacttctgatcagcaagcgtcctccagccaaagttgattcgtgttccagtaaagaattggaccagaaagggtctctggagggcctgtgcatactacttgccgaagacacgccagtgcttcagagagttgctacgatcatgctggaaaagttgggggctaaagtcattgctgttggagatggcttgcaggcggtgaatgccctgaacagcagtctagatgtagatgcagaagacttcaggacgacgttgcatttgcaaaacgcgaacaggatgcctcaagcaggaacacgaagttggcaaccttacgacctgatccttatggactgtcaaatgccccagatggacgggtacgaagcaacgaaagcaatcagaagatccgaggccggaagcggcctgcacattccgattgttgcgctgaccgcgcatgccatgtcatcagatgaagccaagtgcttggaggtgggaatggacgcatacttgacgaagccaatcgactataagcttatggtgtccacaattctgtcgctcaccaagggagtcaactgagagaacctgctaagacaacttagagagaaccaaagaaagccagattttaaagtttacacagtttttgcttttgaaatgtgaaagaatcagtatgattaacgaactgggcaagtataccagtgaccccatctgcaatctgtaaagacatctgagtttctctagcttatttctgagcatattcggaaaaaaaaaaaa

SEQ ID NO: 51 - DNA, 461 bp, Eucalyptus grandis
ctctttctaccggcgcttcttcagcaacaactggcatggcgagcaacggcttggtctcgccgcggaggaggtcgtcgggccagtttgacggcagcgacccgtctccgtgcggttccgaggaggtccacgtcctcgccgtcgacgacagcctcgtcgatcggaaagtcatcgagcgcttgcttaagatcacttcctgcaaagtgacggcagtggatagtggactcagagcccttcgatatcttggtctggatgaggagaaaacggctggagattttaacgggttgaaggtggatatgataattaccgactattgtatgcccggaatgactggttacgagctcctcaagaaaatcaaggaatcctctgctctgagggaaattccggtggtgatcatgtcgtccgagaacgtcttggcgcgaatcgacaggtgtatggaggaaggtgcggaggatttcatcgtg

SEQ ID NO: 52 - DNA, 570 bp, Eucalyptus grandis
atcatttcttcctgcgcttcttcagtaaaaactggtatggcgaggaacggcgtggcctcgtggcggaggaggtcgtcggaccagttcgacgacccgtcgccgtgcgggtccgaggatgtccacgtcctcgccgtcgacgacagcctcgtcgaccggaaggtcatcgagcacttgcttaagatctcttcctgcaaagttacggcagtggatagtggaatcagagcccttcaatttcttggcctggacgaggagaaagcagctggcgattttaacgggttgaaggtggatttgataataacagactattgtatgcctggaatgactggttacgagctcctcaagaaaatcaaggaatcctctgctctgagggaaattccggtggtgatcatgtcgtccgagaacgtcttggcacgaatcgacaggtgtttggaggaaggtgcggaggacttcatcgtgaagccggtgaagctgtcggacgtgaagcggttgagggatttcatgacgagagacgtcggagaaagagtgaggagcgacggggagggcaccacccacaagaggaagctgcaagag

SEQ ID NO: 53 - DNA, 1489 bp, Pinus radiata
gcggccgcgtcgacggaggatacagggattggaattcctctgcccgcacaacatcgagttttcaccccatttatgcaggcagacagctctacatctcgaacttatgggggtacaggaattggcctcagtattagccgatgcttgattgaattaatgggcggtgagataagatttataagccgcccaggtattggaagtacattttctttcactgctttgttcaaagtgggccaagcaggggctgatggtgacggtgatttactacgaggtgcaagactgccgactcatttcaagggcatgaaggcacttgtattggatggtaacccagtatgttccctagtcacgaaataccatttacagaggtttggcatagaggtggacagcattactagttctaaagtggctttatctatgctgaatggaatggatggttttccaacagaaggttgtagcgtaaaagatggtatagatatggtgctaatagagaaggatgcttgggggtcccggcactggcatcttatttccttcgcaagtacgagtaggtctctttccaagaggaccctttctacagtcaaagggtttattaaagatgattcttttggctacatcgctgacagctgaagaaactcagaaagctaaagctgcagggtttgcagagacagttattctaaagcctttacgtgctagcatgttggctgtttgtcttcagctagctcttggattttgcaacaggagagagcatctaagagaaccttcgaagacctcctctcctctaagtaatgtattgtctggaaaatccatacttgtggtagatgacaacatcgtcaatcgtcgagtcgctgctggtgcactgaagaagtatggtgctaatgttatttgcacagacagtgggaaatctgcaatatccatgcttcgacaaccacacaatttcaatgcatgtttcatggatgtgcagatgccagaaatggatgggtttgaagctacgcgacagatcagagcagcagaacttgctaacatggagtgtacaagcaacggcggtgaaactctggctaccaacaatagatggcatgtgccaatcttagcaatgacggccgatgtaatacaggcaacccatgaggaatgcctgcgatgtggcatggatgggtatgtctcaaaaccttttgaagaagaacaactatacaaggccctagctccattttttgaggagtcattatttagatattgtttaaatattggctttcagtgtttaaggatttcatattccccgtgtataatatatagaataggatccaacgattcggtttttgtctgaaagttagacctccttgcttgaggccttgttatggcatgtagattgattgcaagcatgtagagttttatatgctgcgggtgaagtccgtgtaagatcaatatttgtaaatttgaagttagggctgaatggaaatttaaaggcatttgctgtgcgggtatttgcattaaaaaaaaaaaa

SEQ ID NO: 54 - DNA, 370 bp, Pinus radiata
gtcaaagggtttattaaagattattcttttggctacatcgctgacagctgaagaaactcagaaagctaaagctgcaggttttgcagagacagttattctgaagcctttacgtgctagcgtgttcgctgttcgtctgcagctagctcttggattttgctacagaagagagcatctaagagaacctttgaagacctcctctcctttaagtaatgtattgtctggaaaaggcatacttgtcgtagatgacaacattgtcaatcgtcgagtggctgctggtgcactgaagaagtatggtgccaatgttatttgcacagacggtgggaaatctgcaatttccatgcttcgacaaccacacaatttaatcactagt

SEQ ID NO: 55 - DNA, 398 bp, Eucalyptus grandis
ggtaatcgaaagagagacggaaaatacagcaaaaggaagagcacgagtttcgcttcaactatttctaccggcgcttcttcagcaagtggtatggcgagcaacggcttggtctcgccgcggaggaggtcgtcggaccagtttgacggcagcgacccgtctccgtgcggttccgaggaggtccacgtcctcgccgtcgacgacagcctcgtcgatcggaaagtcatcgagcgcttgcttaagatcacttcctgcaaagtgacagcagtggatagtggactcagagcccttcgatatcttggtctggatgaggagaaaacggctggagattttaacgggttgaaggtggatatgataattaccgactattgtatgcccggaatgactggttacgagctcct

SEQ ID NO: 56 - DNA, 438 bp, Eucalyptus grandis
tgttctttcaccctttcctcctcctccccgttgttcctcgccgttgttcttggtcgatcgccgatcgaaatgggtgtcaccgccgcgtcgcaatttcatgtcttggcggttgatgacagtctcatcgacaggaagctgattgagaggctcctcaaaacctcctcttatcaagttactgcagttgattctggaagtaaggctctggagtttctgggcctgaatgagcagcagcccagaaatgccaacgctacctctgtctctccaagctatcatcatcaggagatagaagtgaatttgatcatcacagactatttcatgccagaaatgacaggatatgatctcttgagaaagatcaaggaatcgaatagttacaaggacgtaccagttgtgatcatgtcgtctgagaatgttccctcaagaatcagccaatgtttggaa

SEQ ID NO: 57 - DNA, 1280 bp, Eucalyptus grandis
gggaagttggctgtctatgtctctgatcgggtaccggaagctgttattggtgatcctggtcgattccggcagataattacaaatcttgttgggaactcaatcaagtttacacatgaagggcatatatttgtctcagttcatctgctagaagaaggatgcagtcagcatgattttagagatgtggagaagagactaagttcaaacttagttgaagatacatcggacaaaacttttaatacattgagtgggtttcaagtggttgacagaaggaaaagctgggagcgctttaagaagttaaatcggtccgatcaaattgatgtgaatgaatcagttgaagtacttgttactgttgaggatacaggtgttggaattgccagagaggcacaaagccgcatattcacaccttttgtgcaggctgatagctccacatcacgtacatatggtggcactggaattggcttgagtattagcaaatgtctagtggatcttatgcacggggagatcgggtttgtaagtgaaccgggcactggaagtacattttcctttactgtaccctttgcaaaatgtgaaatgaactgtcttgaagtgaaggggcaaaattacgattcaatcatatcagagttcagaggattgagagccttggtgatagataaaagacacatccgagctgaggtcgcaagatatcatcttgagagactaagaatatcagtggacgtcgcttgcagtttgaagtcagcctgtacttacctttccaactcttctagcccaagggaactatcggattttgacatggttctcatcgacaaagatgtttgggacaggcaaacaggtttagaactcaatatttcactttggaaacacaggcaaaatggcagcaatggagtgtcaatacgtcccaagatttttcttctggctacatccattagtccaattgagcacagcgagctcaaattagccaacctggtagataatgtgctggcaaagcctctcagattgagtgtcttgatatcctttctccaggaagccctcggtaatggtaagaagaggctatctgataggagaaaagtatcaactcttggcagtttgctgaaaggaagaagaatcttggttgtggatgacaacttggtaaacagaagagtagcagagggtgctttaaagaaatatggtgccattgttacctgtgttgggagcggtaaggatgctgtggccaagcttcagccgccccatgacttcgctgcttgcttcatggatttgcaaatgccagagatggacgggtttgc

SEQ ID NO: 58 - DNA, 582 bp, Eucalyptus grandis
tcagcttcctcttcctcttccccttataaccagacatcaaaacccccccatttcctttcttttcaaaactcaccaggccacccacagttctttcccacttcagactctctctctctctacatctgcctctggataattttccgttttccacagaaagggtccttttgtttcttgtccctagttgttcatacatataggtttgtatctctgggaagcagagatttctggaggatcttttgttggccttcacttttgattgatgatggagagcagcaaaggcttctcttctcctcggagcaacgggttccccgccggattgcgcgtccttgtggtcgatgacgaccccacttggttgaagatcctcgaaaagatgctcaagaaatgttcttatgaagttaccacatgtggtttagcaagagacgccctgaaactgcttcgggaaaggaagggtggatatgacattgttattagcgatgttaacatgccagacatggatggcttcaaactcctagaacttgttggcctcgagatggatcttcctgtaataatgatgtctgtggatggggagacgagcagagttaa

SEQ ID NO: 59 - DNA, 534 bp, Pinus radiata
gctgaaacttgatagaagctgcagagttacacgagttgtatgattagtcagcattattgaaggaacggcaccttttggttcttgcttcgagattttggagcccggattcccgatgtacacaatagcgcatgaaagtaaatacgcaactgcataattttcccttcagcagccatggttacctcacgaatgtcttcggcgatgagaatgaagaaggaaaaaaatgctgcatgtggtgagcatggggatgaactggttcgatgcgacgaaatgcatgtattggcggttgatgattgcctgatagaacggaaggtcattgaaaagcttttgaagactaactttttcaaagttacctctgtagatagtgccgaaagagcgctagaagtcttggggtttcatgaagagcagtcgacatgtgcgaccactaacgcgttcaaggttaatatgatcattaccgattattgtatgccaggaatgacgggctatgatctgctgaagaaagtcaaggaaaccaaatgtctgaaggagattcctggt

SEQ ID NO: 60 - DNA, 584 bp, Pinus radiata
caggaatggatggatttgaaactacaaaaagaatttgacagatggaacaaagtccaagctaggaattcctactgggacagtcatcctcagagccacgtgaaaatatctcgaatttccacctactgatcttggccatgactgcagatgtgattcacgctactcatgaataatgcacaaagtatggaatggacggatatgtttcaaagccctttgaagcggaacaactttttagagaagtttcgctccttttcctggtcatcactgaatcaaaacttgtagagaggccaccatagatggttaattgttttggtgagcaaaagtcttggttgtttaggcactttggcagccttactggtgaactttcgaattctttaacaagagagttttctctggcctctccttagctacacatttcttgattctcttgcttttagagcagttggatttccttttgatagatgcaattgaaattcgctgacatatctcatgtgaaaccaaagggattttcttcggaaaccatatacataaagaagctaaggtcacctgctggagttgaattttcaaaaaaaaaaaaaaaaaaaaaa

SEQ ID NO: 61 - DNA, 702 bp, Pinus radiata
agaagggctgtttcagtttgagttgcccttgaacaaaatcttctatgaatttattcaagaaaagattcaagccagcaatgcttgggtttgagctgaaaaaaacagagacagagacagaagaactaaatttattagaaagaaaaaactaaaattactaacaggtggatacagatgcagagggttaaagtaatgaagaagataaagagagggtgattcaatttgtttgtagaagccgacgcagggcttcaacaacctcaacctcaagacgactacgggtttctttcatggttggttggagaacgaagagcaaagcaccagaattagaagaagaaggatgtttagggttcaaagagggtttggattaggtttcaccaaccgaggtcgatctatctcaagtatctatgatggttcccatcagatagaagcttccaagattttatacgagcttaaaacagtgaattcaagcgaaggaaaaaagttcatgcaaataaatggaaaacaggtggagggaggagggtgatacgaatttaatgaacaatagaacatcaatgagccataaggcaaggtcgaaggaagcataagagcagagccataaggcaaggttgtaggaagcattagagcagaacaaagcacaacatagaggaaataaatacctggaattagaagaaaagcagccctgtcggtacatcaaattgtcttacg

SEQ ID NO: 62 - DNA, 600 bp, Pinus radiata
gtcgacagacaggcaaagcaaggaaggaggacagagggcagatggtttctgatgtcaattaatgagacaggcacagtaaggaaggaggacagagagaggggttcatgtgaaacccaacggacacagaaggaagaaggacacagaaggaataagggctgcttcagtttgagttgccgttgaacaaaatcttcgatgagtttattcaagaatagattcaagcaagcaatgcttgggtttgagcagagaaaaaacagagacagagacagaaagaactaaatttattagaaagaaaaagctaaaattaataacaggtggatacagatgcagggggttaaagtaatgaagaggataaagagagggtgattcaatttgttggcaggagccgacgcagggcttcaacaagctcaacctcaagacgactacgggtttctttcatggttggttgaagaacgaagaagagcaaagcaccagaattacaagaaggaggatgtttagggttcaaagagggtttggattgggtttcaccaaccgaggtcgatctatctatcatggttcccatcagatagaagcttccaagattttatacaagcttaaaacagt

SEQ ID NO: 63 - DNA, 1656 bp, Pinus radiata
gcggccgcgtcgacctttataaaccatattataagactgagtaatgtgacaattaccattaccatataccccacagaagaagagagtcagtatttgggttcccagcttctgcacaatctgtaatattttgggtttattgagatggctgtatctcaacatctgtttttgagtgctcaacgcctaaatgggagagaggatgaaggcagtctgtaccttttgagagcaggggtgaactgggacctgctgataatgggtgttgctctggtggcctgtttggctattttagggatggtttggaagcgtaggaggacatggtcttattgtgagggtttgcaggaagaagatgcaggccagagagctcaggaaacccaatgctctaaaggattcatgaccaacgtgtttcacaatacaagagattgcagatcagaacagattatttgggatgatatccacatttcatctcagactgaaaccagaagtcagaaagttagaactgtgaagtcaaaaagttccatgatttctcgggattcttgtagctcccccagacgaatcttgctcgtggaagacacacaaatcaacagaataattttcgggagggtgcttcaaagccttaatctttactgtgaagaagctgagaatgggaaagtagcagtggactatttcaagcagggcagaacatatgatcttgtgttaatggacaaagagatgcctgttatggatgggcatgaggcaacaaggcaactgagatcaatgggagtcaagacacccattgttgcacttacagcaaataccttgcaatctgataaagacctcttctttgaggctggtgttgatgattttcaatcaaagcctctgtccagagacagacttgtacaattactagatcaatatggtgtggatggttgtgctggcaacagaaggggttgaaagagtttcaaggtttcattgtattatacccatggcttcgttatgaaaaaaaacagtgcagattgcaggttgcctgctttgtaagtcttgatctgcattattgcagtgatttgattaagccacgaggaatatggttttagggtttccagacatttgcaatcctgcaatcctcctgagcaacactgaactttcctacatcttggggaaggcaggtaggctagagctggaagtaaaatgtgaacaagttgtgaaaagtgcataaactggtataaagcaaaacaattgatttttttcaagcagcagtgtcaaagctgaagttgcagcactattaaaaagctggaaatgaatcttggtggggagagaaagaatttgaagttgcagcactattaaaaggctggaaatgaatcttggtgggggagagaacgattctttctctcgactatccaagttatactcaattgatcttcatcttctgtgaaggactttggtcacaggaattccttctcaagatcaatcaaaacggttttgagccacacaaattggcaacaggctgggatcaacaagaagacttatgagagagcttttagttttttcagtggagccgaacagtgggactttgggaaatgcttgttcaaagttcttaactccttcgcctatatgggtggcctgcacaatttgtatctataataaggatttcttaaaaaaaaaaaaaaaaaaaaaaaaaaaaaa

SEQ ID NO: 64 - DNA, 360 bp, Pinus radiata
gggtatttgggttctacgtcttctgtgcaacctgttaatttctatctgttttggtttattgaggtggctgtacctcaacatctggttttgggtcatcaatacctaagtgggacagagggaggagacggtctgtactttctgagagcagggttgaactgggtccttctgataatgggtgttgccctggtggcctgtttggctatttttgggatggtttggaagcgtaggaggacatggtcttattgtggggctatgcagaaagaggatgcaagccagagagctcaggaggcccaatgctctaaaggatgcatgaccaatgtgttgccgaatacgagagcttgtagaggagcacacattata

SEQ ID NO: 65 - DNA, 466 bp, Pinus radiata
aacagattgcagatcagcacgcattatttgggatgatatccacatttcatctcagactgaaaccacaagtcagaaagttagaactgtaaagtcaaaaagttccatgatttctcaggattcttgtagctcccccagacgaatcttgctcgtggaagacacacaaatcaacagagtaagttataccaggactgattcgttgtttggttttaggatgctgcttgtggccatataaggttaattttcctggagcttgctgctgaggtctcattcattattttacactgaatcaacctcagataattttcgggagggtgcttcaaagccttaatctttactgtgaagaagctgagaatggaaaggtagcagtggactatttcaagcagggcagaacatatgatcttgtattaatggacaaagagatgcctgttatggatgggcatgaggtatgcaactgttaaatctgtaa

SEQ ID NO: 66 - DNA, 642 bp, Pinus radiata
aagcgatttctggagggccacgagctgtcttatctccgagccatcggtgttattattctgtccgctgtgctgaagcggcgcatgatcctggcggacaaggcgaagagtctcttcatctccaacatatcacacgagttacggacaccgctgcatgggattctcgcagcggcggaactgctcggcgatagcccgttaaatcactcgcagctctccttcctcgagactgtacaggcgtgtgggacttcgcttgtcgagacggtaaatcacgtgttagatttcaccaagctgagcgggaactccaaggcgggcggggtggagaaggtgatcgtgccgaccagggtggatctgatgcagctcatcgaggaggcggtggatgggtgctggattggacatcgggcccggacagcgatcatgggcgacacgggcatcggaagcgtgtattcgccaccggaggatttatcttctcccaagcagctcgttgagaccgtcgtcgacattggatggcgcaaaaagggatggtcgctcaagtgcgagaaaggcgggatccggcgggtgctgatgaatgtgtttgggaacagcctgaagtttactactaacggatacgtgcacgtaattctgcgtgagctgcctcggagcggcgat

SEQ ID NO: 67 - DNA, 909 bp, Eucalyptus grandis
gttgaaaactcctcaacaagaaatcgtgcgttcgtacagtttcatctacatcaggaaaggctctttgctctgatcttttccttgcgagttaatcattatgacgatggccggcgaaattctccggcggcagtcgccggcggaggtcgacttgtgtggtgggtcgggtcaggagctgcatgttcttgcggtggatgatagccttgtggataggaaggtcattgagaagctgcttaagagattgtcttgtaaagttacggctgttgatagtggattgagggctttgcagtttctgggattggatggagagaagagctctgttggacttgatgatttgaaggttaatctgataatgactgattactccatgccgggcatgactggatatgagcttctcaagaagatcaaggaatcatcagctttcagagaaacgccggtggtgatcatgtcctccgaaagaatcctcgcccgtattaaccgatgtctagaggaaggagcagaggaatttcttgcgaagccagtgcaactgtccgatgttcagcgcctgaaaaatttcgtgatgggtgggggagaagtttgcccggacagaagaatcaacaagagaagactcgaagaaaataacgataacgacgacaacgaaaatcatgccccatcgccggtgtcgcccctgtgcagtcgcgattgggcagtgtgctcatcttcatcgtccgattcttcatcgccatctatagccgtgtcttcatcgaagaggcttaagatacatcatcaagcttgaggatattcattcgtatataccagaatttgatttattgttgttttttggccgatgatcggcatattcatggctaggaatggcgcaccttttgttcagtaaatataatatgatctctttcccctaaaaaaaaaaaaaaa

SEQ ID NO: 68 - protein, 666 aa, Pinus radiata
MERLEMAMFLMLLIIFFFRDCEAQGKSDYHALIAFKASSDINNTLAFSWTHKNPCRRKWYGVGCENGRVVRLVLQDLDLVGPIDALTGLHELRILSLKRNSLNGTIPDFLNWRSLKFLFLSDNYFSGPLPSTIASLDHLLRLDVSNNHLGGQIPLSITSMTHLLTLRLENNEFSGSISDLMLPNTVEEFNVSDNRLSGMIPASLSRFPSSGFVNNEELCGSPLQSCNESNNASSASNPYMASSPSMISGSLPVHRNNSSTQLSKGDIIAIVVGDVAVLSLIGCVIFCYYWKKKGVKQKKPKPKPAQRCPTDRLAVHSSDQCPNNQSITAGKCKLIFFDDGRPFELEHLLRASAEMLGKGNFGSAYKAIMEDGSVVAVKRLKDLYGIGRKEFEQHMELMGSLRHQNVVNLRAYYFARDEKLLVYDYMPNGSLYALLHGSRGPGRTPLDWTTRMKIALGAAKGLAFIHSHCKSPKIGHGNIKSSNILLDRNGNACISDFGLALLVSPSVAASRMVGYTAPEQAATKKISQKADVYSFGVLLLEMLTGKAPVQAHMQEDYHSAIDLPRWVQSIVPEEWTSEVFDIELMRFKNIEEELVSMLQIALLCASQSPQQRPKMSHVVRVIQDIRGDHHSPSMQNSLSQSPSMQEPGHSISDSPSVSEDSGIRGL

SEQ ID NO: 69 - protein, 690 aa, Eucalyptus grandis
MGFASLRSQCLFFFLLWVFIFFASRSDVLVSAATSAELRALMDMKASLDPESRYLSSWTVDGDPCDGSFQGVCCDDEGRVANVSLQGRRLTGRLSPAIAGLTHLTGLYLHYNSLCGEIPRELGNLSALSDLYLNMNNLSGQIPPEMADVASLQVMQLSYNQLTGSIPTKLGSLKKLSVLALQSNQLTGAIPASLGDLGTLTRLYLSFNRLFGSIPMKIADLPLLEVLDVQNNTLSGNVPPALKRLNEGFLYENNFDLCGTGFLSLRTCNALEGRKPSQPQPYGAATTVPSTSIPETANVVLPCNLTECSSLPKSAHPSALIGSILATVALSAIGFLLFTHYRRRKQKLGFSAEVCDGHLSTDQPKSAYKKNGSPLASLEYSNGWDPLADARIFNEFSEEAFQSFRFNLEEVESATQYFSELNVLGKSNFSTTYRGILRDGSVVSIKCINKTSCKADESEFLKGLNMLTSLRHENLVRLRGFCCSTARGECFLIYDYVPNGTLLSFLDLEEGDSGTLEWSTRVSIVKGIAKGIAYLHAHKPNKAPLLHQNISADKVLIDQRFNPLLYQSGLHRLLTNDVVFSLLKASAAMGYLAPEYMSTGRFTEKSDVYAFGMIVFQILSGKQKVDHSMRLAAESCRFQEFIDANIHGRFFEYEAAKLAKIASLCTNESPYDRPSMDAVIHELSNCSSCL

SEQ ID NO: 70 - protein, 655 aa, Pinus radiata
MYWSQMGNIRQLFNGFFMLVLVVAVVKGEPTGDKQALLDFLSKVPHGRRLNWNASSSACTWVGVTCNSNKDRIWEVRLPGVGLFGPIPPGTLGRLTELRVLSLRSNLLTGSLPSDLANAKALRSIYLQHNLFSGPLPPFLSQWGRLSRLDLSFNRLNGSIPFSLNNLTHLTGLLLQNNSLSGSIPNLNIQNLTLLSVANNQLNGSIPRSLQKFPKTSFQGNAQLCGVPLKLCKSFFPSPSPSPNGSAVPRRSKKSKLSTGVVVAIIVGAVAVLFLLLACLFLCCVRKHRGESATEKPQKDERTTVEKGGPSKEEYMGTAQETERNKLVFFEGSQYTFDLEDLLRASAEVLGKGSVGTAYKAVLEDGTTVVVKRLKDVAVNRRDFEQQMELVGRIRHRNLVPLRAFYFSKDEKLLVYDYMPAGSLSALLHGSRGSGRTPLDWETRMRIALGAARGISHIHEEGGGKFTHGNIKSSNVLLTSDLDGCVSDFGLVPLFSAAAAANRIAGYRAPEVIETRKVTQKSDVYSFGVLLLELLTGKAPNQASLNDEGIDLPRWVQSVVREEWTAEVFDVELMRYQNIEEEMVQLLQIAMACVATVPDQRPRMQDVVKMIEDMRQFETDEGNRQSSDDKSKESNGQTPPQQATPEARTPTARTP

SEQ ID NO: 71 - protein, 630 aa, Pinus radiata
MQQPYVVLALLWMLLLHHPLWRVFANTEGDALHSLRSNLLDPNNVLQSWDPTLVNPCTWFHVTCNNDNSVIRVDLGNAQLSGSLVPQLGLLNNLQYLELYSNNISGPIPSDLGNLTNLVSLDLYLNNFTGLIPESLGKLSRLRFLRLNNNSLVGRIPMSLTTITALQVLDLSNNNLTGEVPANGSFSLFTPISFGGNQYLCGPVAQKPCPGSPPFSPPPPFVPPPPVAGSNGARVQSSSSTGAIAGGVAAGAALLFAAPAIGFAWWRRRKPQEHFFDVPAEEDPEVHLGQLKRFSLRELQVATDGFSNRNILGRGGFGKVYKGRLADGSLVAVKRLKEERTPGGELQFQTEVEMISMAVHRNLLRLRGFCMTPTERLLVYPYMANGSVASCLRERAQNDPPLDWPTRKRIALGSARGLSYLHDHCDPKIIHRDVKAANILLDEEYEAVVGDFGLAKLMDYKDTHVTTAVRGTIGHIAPEYLSTGKSSEKTDVFGYGIMLLELITGQRAFDLARLANDDDVMLLDWVKGLLKERRLDMLVDPDLKNNYVEAEVEQLIQVALLCTQGSPMDRPKMSEVVRMLEGDGLAERWEEWQKVEVVRSQEVELVPHRNSEWIVDSTDNLHAVELSGPR

SEQ ID NO: 72 - protein, 910 aa, Pinus radiata
MLLLATLSFILFLNPFAFSTPIAHFPHHPPRLTNASDQHALLAFKSAITYDPSQSLATSWLPNVSFCQWTGIICSRRRQRVISLNVSSMGLQGTISPLLANLSFLTVLDLHNNSFDCHIPYQLGTLFRLKMLRLSKNQLQGSIPPTLANCRSLRNLTLSFNNLTGNIPPQLCLLPNLICMSLGINNLTGTIPDCLGNISSLQYLSLSQGNLQGSVPSELGRLSQLIVLDLFGNHLTGCIPSSLSNCTNLELLDIGDNQLVGHIPSHLCTKKTTQLMYLRLGANQLSGSVPSSLFNCTKLQEIALPYNQLSGIVPMELGKLTHLQRLFFGGNYFISGNTMRCPILTALSNCSDLQYVDLSENNFTGQLPFSIGHLSKKLYHLDLGSNELAGEIPPAIGNLSSLTFLNLGRNYFTGSIPSSLIMLQKLERLYMDSNNLQGNIPMEIGQLKSLGLLYLSGNNLSGKIPDFVANLQQLRYLYLNHNQLSGDINANLGKCVNLLLLDLSYNKLSGHIPQELAGLANLAFYFNLSNNLLSGHVPLELGKFDMLQAIDISANQITGYIPSIVGSWKEVAYLNLSYNALEGPIPVSISELLSLQDLDLSSNNLSGGIPISLANLTMLHHLNFSFNKLSGEVPKEGVFKNIGATAFMGNLGLCGPWVNLPPCYAHKHKSVLNLKRVIILVVVVAIVVLCLFLAILWRKNCRRNIQRDIGPSLNVGHRRISYAELVIATNEFSDANLLGIGSFGKVYKGILNDGTMVAVKLLNLQNEGAQKSFDRECKVLGRVRHRNLIRVITCYSDLQIKALIFPLMPKGSLEKWLYPDDGEQSCLNLIQRLNIAIDIAQGMTYLHHHCFVQVIHCDLKPNNVLLGEDMTAYLIDFGIATICFANNEDGALTSTNALKGSTGYIPPGII

SEQ ID NO: 73 - protein, 947 aa, Pinus radiata
MRYSWTCSPFLSLLFILSCLDSGICLDNQQTQVMKKLSSYTPSWTTVKSDNPCGWSGVNCTAEESNVTELHMSGFRMKGNAWQTICKLQALQVLDVSDNLLSTPSDNDIQACTNLFSLNISSNFLPGSSLPSLAPMRKLHFLDVSHNGFAGEFGPQIQHLTDLRVLNLTYNNFSGPIPSFLGNLTTLEKIDFSQNYFEGEFPKELVRCTSLTYLDLSFNRLTGQIPDNISNLIHLETLILSSNNLTGTIPKTLDRLVNLTHFASNKNQLIGRIPVQLAKLTELHFLDLSYNGLNETIPPELFALSNLQTLDLTKNLLTGEIPQNFSRKLIRLRIGQNLLKGNIPLTIGNWSNLTYLEMNDNSLDGQIPQQLVNCIKLQLLDLGNNNLSGSLTNQLPSLLQLQVLKLHNNNFVGSIPYILSSFSNLSYVDLSDNTLNGSIPSNIFNLSKLQNLRLQNNKLTGAIPNTVGGSQVLLELQLGGNNLTGTMPLEIGFVRKLQIQLNLSCNSLEGEIPNTLSGLYMLEILDLSNNKLTGEVPGSLTAMLSLTLLNISNNSLTGVLPKFPNSTSALIIIDTGNPGLTAGQNGSAPAASARKKISAILIIGVAVAGAVFAIVAVGLFIVASKYFGRGDQQMPEVQLARKIEGHFIHPDSIHRLRIDFEKGVEATLDPANVFLKNKFSTYYKAVMPSGISYSVKKLNWSDRIFKSGSYRKLGAELEKQGKLRHPNILTPLAHVLDTDSAYLFYEYVHKGSLSEFLHTSNVSVLDWPSRCRIAIGVAQGLAFLHGCQHPIFHLDLTTKNILLKSLTEPQIGDIELCKIVDPSKSTGSISAIAGSVGYVPPEYAYTMRVTAAGNVYSFGVILLELLTGRTPITSGMDLAKWVQSTLSGEETWEQILDTGIRNFSVQIQNEMIAMLKVALSCVSSSPESRPKMRNVVGMLQMVRQVAE

SEQ ID NO: 74 - protein, 638 aa, Pinus radiata
MHFKILFDAKEEKIKSSFDMLTAFLVLCFTTTAASATQLSPSGLNYEVAALMAIKNSLNDPHNVLENWDINSVDPCGWRMVTCTLEGSVSILGIQCQNLSGSLSPSIRNLTNLQSVLLQNNAISGSIPAELGKLDKLDTLDLSNNHFNGLIPSSLGKLKNLNYLRLNNNNLSGPIPPSLATITGLTLLDLSCNNLSGSVPRISARTFNIVGNPLICGPNSTYKCPGQFPTPIPLVVETPQGRVPSRQSKTRKLAVALVASLGFVFVVSIGLLLWWRKRHNQQIFIDVNEQHNVDICLGHLKRFSFKELRVSTNNFSSKNILGVGGYGIVYKGFLQDGTIVAIKRLKDGNVGGGEIQFQTEVEMISLAVHRNLLRLYGFCTTSRERLLVYPYMPNGSVASCLRDHINGKLALDWPTRKRIALGAARGLLYLHEQCDPKIIHRDVKAANILLDEYFEAVVGDFGLAKLLDHRDSHVTTAVRGTVGHIAPEYLSTGQSSEKTDVFGFGILLLELITGQRALDFGQAAKQKVVMLDWVKKLHQEKKLHLLADKDLKGNFDRVELEEMVQVSLLCTQFQPGHRPKMCDVLRMLEGDGLTERWETLQKIETPRYRVTEIPITYSELVEEDSSWLVQAIELSGPR

SEQ ID NO: 75 - protein, 659 aa, Eucalyptus grandis
MHFRILALLGFFFLAVLFPSAEPDLASDRAALLALRSAVGGRTLLWNANLPSPCSWAGVQCEGNRVTALRLPGVALSGQIPDGVLGNLTQLRTLSLRFNALSGTLPSDLASCADLRNLYVQGNLFSGPIPASLFGLSDLVRLNLASNKFSGDFPAGFGNLTRLKTLLLENNQLSGSIPADLKQLKLEQFNVSNNLLNGSIPEGLGAFATSSFSGNSLCGKPLASCSQDIALPAGEPSGSPGQPGGKKKKLSGAVVAGIVIGCVFGFIFLVILLIYLCRKKGSKKSRSVDVATFKHQELEIPGEKPVGEVENGGFSNGYSVAAAAAAAMTGSGKGEVNGSAGAAAKKLIFFGNSARAFDLEDLLRASAEVLGKGTFGTAYKAVLEAGITVAVKRLKDVNVAAKEFKEKIEAVGAMDHQSLVPLRAYYYSNDEKLLVYDYMPMGSLSALLHGNKGAGRTPLNWEIRSAIALGAARGIEYLHSQGPIVSHGNIKSSNILLTTSYDARVSDFGLAHLVGPSSTPNHVAGYRAPEVTDPRKVSQKADVYSFGVLLLELLTGKAPIHSQLNEEGVDLPRWVQSIVREEWTSEVFDLELLRYQNIEEEMVQLLQLAIDCAAQYPDKRPSMSEVRSQIEELCHSSSQKDRAPQLDQVNEVNDDTSSR

SEQ ID NO: 76 - protein, 968 aa, Eucalyptus grandis
MEEAFLRLIFLVAVLLFGKDLQLVFSFTNPDDSVALQSLKMSWQNTPPSWERSSDPCGLPWEGVTCNSNSRVTSLGLSTMGIKGQLISEIAGLAELRSLDLSFNKELTGPLARQLGNLQKLNILILAGCSFTGSIPDELGNLAELSFLALNSNNLTGNIPASLGNLSKLYWFDLADNQLTGPIPISTDTSPGLDLLLKAKHFHFNKNKLSGPIPEKLFNSAMVLIHVLFDGNQLNGSIPSSVGLLPDLEVLRLDRNKLSGKVPLNLNNLTNLSELNFAHNALTGPLPDLTDMNSLNYVDLSNNFFDPSEAPDWFSTLPTLTTLVIEYGPLKGVVPQKLFSFPQLQQVKLKNNEFNGTLNMGDNISPQLQLVDLQNNQISSVTLGSSGYSNTLMLIGNPVCTTELSNTNYCQLQQQTVKPYSTSLASCGSKSCPPDERLNPQSCECAFPYEGTLYFRGPSFRELSNVTLFHMLEMDLWTKLNLTPGSVSLQNPFFNLDDYLQVQLSLFPPSGKYFSRSDIQSIGFDLTNQTFKPPKPFGPYYFIASPYAFPDNGGTAISKGVIVGIAIGGTVLVLGLVVLGLYAIRQKKRAEKALELSRPFASWAPSGKDSGGAPQLKGARWFSYDELKRCTNNFSDSNELGFGGYGKVYRGVLPDGHILAIKRAQQGSMQGATEFKTEIELLSRVHHKNLVGLIGFCFEQGEQMLVYEYMPNGTLRDSLTGKSGIYLDWKRRLRIALGSARGLAYLHELANPPIIHRDVKSTNILLDEHLTAKVADFGLSKLVSDSGKGHVSTQVKGTLGYLDPEYYMSQQLTEKSDVYSFGVVMLELITAKQPIEKGKYVVREIRTAMDKNDQDYYGVREMMDPSMRSMGYLVGFSRFLDLAMRCVEESAADRPTMSEVVKAIETMLQNDGIHTNSTSASSSATDFGSTKGAPRHPYNDALPKKEVSYSDSFDYSGGYGLSTKIEPK

SEQ ID NO: 77 - protein, 632 aa, Pinus radiata
MLFPWRSLVLIAFTSLVVQLIPAQAVEDRRHDTTFLFDGFNGTNLILEANASVIGSESVLSLTNHSHEFMLGRALYAAPVQMKNNHTVSSFSTTFVFSIVPPPSNEGGHGLAFIMTPYTSPMGAQPVQYLGLLNLTSNGQPYNHLFAVEFDTIMNVEFKDPDRNHVGVDINSLISVQTETAGYWNGEEFHELNLRSGRNIQAWIDYDHLESSLNVTITVAGLPRPQRPLISLQIDLQNIVEEKMLVGFSAATGLLVEDHYILAWSFTTEDTAPPLDVSCLSSFANMYSEPLSRGFIAGVTVVSVVLFWLVIAAAMFLRRTLNRETVEEWEQEYWPHRFDYKELRIATRGFRDENLLGYGGFGMVYKGFLPRSGQEVAVKCITTEFKEGIKGFVAEISSMGRLQHRNLVQLRGWCRRHTQLFIVYDYMPNGSLHKLIFGSPTTVLPWHRRYAILKGVAAGLLYLHEQWEKRVVHRDIKSSNVLLDSEFNGRLSDFGLARLYDHSENPETTYVVGTLGYIAPELIQTGKATPSSDVFSFGVLLLEVACGKSPVDSLEDSERMILVEWAWELYTEGRLLEASDPKLAAKGGYDEGEMEKVLKLGLLCSHPEPESRLSMRQVCQVLNGEAPVPCRW

SEQ ID NO: 78 - protein, 903 aa, Eucalyptus grandis
MGLKIFSVGFALLCCFCSLGFCDQDGFLSLACGGTTNYTDSSNIWWITDSDFISTGKTTYVDNIEGNSSGVSLRFFPDSKVHNCYRLPVRNISSLILVRSQFVYKNYDGRGKPPAFSVSLGTAMASTINLTTNDPWTEEFIWPVDKDTLSFCLHRIRNGGTPVISLLEVRPLPPEAYKSGMGDYPNKLLRKSYRIDSGYTNGSLKYPADPYDRIWDADKSFTPFHVTTGFKIQVEFNLSGLSESPPPAVLQTARVLARKEVLTYNFPLDSLGDYYVVLYFAGILPISPSFDVIINGDIVQSNYTVKTSAASALYVTRKKIKSLNVTLKSKRFFPQVNAIEVYELVDIPPEASSTTVSALQVIEQFTGLDLGWEDDPCSPKPWDHVGCEGSLVTSLDLSDINLRSISPTFGDLLDLKTLDLHNASLAGEIQNLDSLQNLEKLNLSFNKLTSFGSDWENLISLQVLDVQNNSLDGVVPDGLGELKDLHLLDLENNLLQGTLPDSLNRQSLEVRTSGNLCLSFSTTACGDASSSPSIEAPQVTIVPERNKGGHNRLAIILGAVGGVSLAILLIPLFVFMYRRRGRTEMSYTERAVADVRNWNAAKIFSYKEIKTATNNFKEVIGHGSFGSVYLGNLPVGKLVAVKVRFDKTQLGADSFINEVRLLSQVRHQNLVSLEGFCYESQRQILVYEYLPGGSLADQLYGPNSRKFSLSWVRRLKIAVDAAKGLDYLHNGSNPRIIHRDIKCSNILLDKEMNARLCDFGLSKQMIQPDATHVTTVVKGTAGYLDPEYYSTQQLTEKSDVYSFGVVLLELICGREPLNHSGTPDSFNLVLWAKPYLQAGAFEIVDESLGGSFDVESMRKVAKIAVRSVERDASLRPTIAQILSVLKEAYSIQLSYLAASGHVN

SEQ ID NO: 79 - protein, 711 aa, Pinus radiata
MGCRKAVRSVSPQNPSSSLMHLRLLGVLLMLHCIDGLILNPEVSTLLTLKPTLSGTGVNVVLASWSASRPLCGWKGVMWMYNGIPVNCSVPKFRHSVALAYSRKVSVLGIDLEATGLKGTVPKELGSFIYLQQLNLNNNSLTGGMPPELGNVPNLSSLQLKNNGLNGGIPTAIWNLCDNITELELGFNELSGSIPEPGNGSNIGCPQLRRFEVNNNSLTGTIPSFLANCISLQELDLSGNSFTGEIPNELANLPNLTTLNLAHNNLSGRIPSFRQKFDKNSFVENSGSLCGQPLLNPCGVAPNAASAASANVTAAQFNVTKAHFKSMSTGAIAGIIIGSIAVVVIASSLLIGCYHRFSTDATDKSSSSSAPSKKDKEEDMDNVSGKLINFQGGEHLTVDDVLNATGEVLGKSSYGTVYKARLSSGCMIALRLLRDGCLRSTDEFMPAIQELGTIRHKHLVSLRAFYSGTRGEKLLAYDYLPRGSLAELLHSTNRPAPGWARRHKIALGAARGLAYLHTGFHKSIIHGNIKSKNILVDDNYVAHLSDYGLNKLMNSTANIEMLEAAASQGYKAPELIKMKRANAKTDIYSFGIGLLEILTGRRPGRTSSSNHIVDLPTVVKNAVLEERISELFDLELLRAMRSPADEGLLQVLQLAMGCCAPSPSVRPHIKEVVRQLEEIRPKPQSPHLALSPQYNSDDKSSREFLLDGGQN

SEQ ID NO: 80 - protein, 707 aa, Pinus radiata
MGKKILQCLRLIIAILTASIAISHGTTDPDDVSALKGIYSSLNSPQQLSGWSANGGDPCGQSWKGVSCSGSSVTLIKLSGLGLSGSLYYQLSDLSSLTTLDLSNNNIQGNIPYALPQKLQELNLASNGLSGTIPYSISNMTGLTDLKLSHNQLSGQIQDIFGQLSSLSTLDLSFNTLTQNLPQSFSSLSSLSVLYLQNNQLAGSVNVLANLPLTDLNIENNRFSGWVPNAWRSNQNFKYSSGNSFATGPAPPPPPYTPPPPSNNRPPKSSNVVPSSGGSKGGNSNKKSLSGGAIVGIIFAVILTVVAAILGVILYARKSPRREQDEEKLSNRVSFTPLSPLDAELLKESPEQKVSSSPLEIALKPPPSERNKSTGDKGFGSIFSSKRTKNPISATEYSIADLQMATNSFSQDNLIAEGALGRIYRAEFPDGKILAVKKLDTSTLSLQRPEDFLDAVSNISRLHHPNITELVGYCTEHEQYLLVYEYFDNGSLYDVLHMADETTRNLSWNIRVKIALGSARVLEYLHEVCSPSIVHKKFKSSNILLDDDFNPRLSDCGIAALNPNSERQVQVLGSFGYSAPEYVMSGIYTMKSDVYSFGVVMLELLTGRKPLDSSRTRSEQSLVRWATPQLHDIDALAKMVDPALKGSYPAKSLSRFADIIALCIQPEPEFRPPMSEVVQALVRMMQRASLNKRMTGDETADHDPADY

SEQ ID NO: 81 - protein, 20 aa, Pinus radiata
MQQPYVVLALWWILVLRHPL

SEQ ID NO: 82 - protein, 89 aa, Eucalyptus grandis
MRVLFIVLGVVLLCTVIPGSSSSVSDVDVLLALKQGFQSPEPALITWSSSNSSSVCLWYGIRCSRGRVVSLQLTDLNLGGSVSPPVSRL

SEQ ID NO: 83 - protein, 153 aa, Pinus radiata
MLLCFVLVAGTSAAVDDHQYLYHPSHYVMNERQESGSSMARHEKRDVEALLSFRNAITADPHGLLSNWTAHNSANICSWNGIGCRKQSRRVVSIYLRFSHLEGTLSPSVGNISLLHTFVLTVNKLTGRIPPEFGQLKALQTLDLYRNLLSSSG

SEQ ID NO: 84 - protein, 154 aa, Pinus radiata
MDLLLLLLVMMGVAMPTHSQHTGGFTSVQRFPFNGRSMMGKPSIAGYHEKRDVEALLSFRKGITLDPYGWLSNWTANNSHNVCLWNGISCSPNTNRVVEISLRYGRLNGTLSPYIGNLSLLRHLDLSSNALSGRIPAKFGQLKALRILDLSNNA

SEQ ID NO: 85 - protein, 82 aa, Eucalyptus grandis
MVFRRFVVMLFICTASVCAGLTDPRDVAAINSLYVSLGYPPLRGWLLVGGDPCVDNWEGVECVISNITGLNLSGANLGGELG

SEQ ID NO: 86 - protein, 103 aa, Eucalyptus grandis
MGFFYQVFLIFLAVAPSALCQVTEFVSIDCGGSSNYTDPTTGLAWIPDTGLMSYGQSSKVQNPNVSSVQYSTRRDFPIDGQKYCYTLRTEERRRYIVRTTFLY

SEQ ID NO: 87 - protein, 156 aa, Pinus radiata
MAFPCFYFPFRILFFLFVCSFSFSFSFSAHKFHDGRKWLLSFKIDITNDPHASMANWSPAVHLCNWTAVTCSRRHADRVVSLDLSGMDLSGSISPSLGNLSFLHTLNLSANALHGHIPPQLGRLFRLRNLWLRNNFLQGNIPTEFASLKHLQQLYL

SEQ ID NO: 88 - protein, 98 aa, Eucalyptus grandis
MRFSSLKRRRWIMRTAIIITSLMCCSSARDSMTLSSPLSDEHGDTLVSDGGTFQLGFFSPNGSSGSDHRRYLGIWYYDSDPQTVVWVANRDHPVLDVT

SEQ ID NO: 89 - protein, 154 aa, Eucalyptus grandis
MGLARLLLVGFVLLVLGSRALVCGNAELEALMEIKASLDPENKVLTSWTSNGDPCGGSFDGVACNEHQKVANISLQGKGLSGKVPPAVAQLKCLSGLYLHYNYLTGEIPREISSLTELTDLYLDVNNLTGSIPSEIGSMASLQGEFCLLLQGQG

SEQ ID NO: 90 - protein, 157 aa, Eucalyptus grandis
MGVKRANSSLCCVVLLGLWACVHGLLSPSGVNIEVLALMDIRNLLVDPHQVLNNWDANEVTPCTWTAITCEADVVTNLEIPRQNLSGTLSHSIGNLINLKYLFLQDNNISGFIPPELGKLQKLEMLDISSNSFSGEIPTELSHLKNLQQLRMNYNNL

SEQ ID NO: 91 - protein, 141 aa, Eucalyptus grandis
MVSSLLLSSQPNLVVGFLFLLLLVDTTPFHGAGDMASSTSFFTINMTKSKDEVEALLNWKSTLDNYSQCLLSSWHDNNPCGFSGVTCDDSKAVNNLNLSNLGLRGTLDGLDFSCLTNLVTFDLSYNAIYGSIPSSIGNLSK

SEQ ID NO: 92 - protein, 90 aa, Eucalyptus grandis
MEGKHLVFLTILLLESICSNVSAIPNEDKQALLDFLGNVSLSRPLNWNKDSSVCRSWTGVKCNNDQSRVVALQLPGVGIKGRIPPNTLSR

SEQ ID NO: 93 - protein, 198 aa, Pinus radiata
MAYKLLRFWLEFQALLVLFPLALSVSQEGLVLLEVKKELSDPNGFLGNWKAEDDSPCKWRGISCDQRSKSVVGIDLSSGGLVGVFPSVVCNLPQLKNLSLGDNNIGSILPRNLSMCRQLQRLNLSQNLFVGNLPDFISELAELEYLDLSSNNFSGSIPAGIGKLPRLQVLNLCCNLLNETIPTFLGNLSNLQQLLLAY

SEQ ID NO: 94 - protein, 151 aa, Pinus radiata
MGSSASPFMVLLLLSTLILEILPMYVATNRSEADLQGLIAFKASITSDPLNALADWTASAHHCNWSGVACDPLHNVISISLPETQIQGLISPFLANISYLASLDLRSNFFHGVIPPQLALCSQLIDLELFNNSLTGIKLIDTVDLEGGPGT

SEQ ID NO: 95 - protein, 151 aa, Pinus radiata
MEVRMITIMILCAALLCEGSGEVDVLMEMKAALDPKGEILYSWVKGGDPCSGTFDGVACNEQGKVANVSLQGKGLSGSIPSTIGKLKCLTGLYLHYNSLGGEIPRELSNLTELLDLYLNVNGLSGPIPKELGAMSSLQALQLCCNKLTGPI

SEQ ID NO: 96 - protein, 116 aa, Pinus radiata
MDLLLLLLVMMGVAMPTHSQQTGGFTSVQRFPFNGRSMMGKPSLFPSSIAGYHEKRDVEALLSFRKGIISDPVGSLSDWTANNSHNVCLWNGISCRPNTKRVVSISLPECLLNGTL

SEQ ID NO: 97 - protein, 155 aa, Pinus radiata
MRERETKVCIFIFCIFTSWALVDFGVPAVFAAQETQIQILLRMKEALEDPTNALRDWDGSEDSPCRWRGIDCNDEGAVTRIQLHGSSLSGRILPDICNLQSLIIFELDRNSLYGNFPPEFSNCSRLEQLNLSSNLLNGSLPDLSKLKALKYLDLS

SEQ ID NO: 98 - protein, 96 aa, Pinus radiata
MPTHSQRFPFNGWSMMGKPSLFPSSIAGYHEKRDVEALLTFRKGITLDPYGWLSNWTANNSHNVCLWNGISCSPNTNRVVSISLRYGRLNGTLSPY

SEQ ID NO: 99 - protein, 154 aa, Pinus radiata
MDLLLLMMMLVMMGVAMPTHSQRFPFNGRSMMGKPSLFPSSIAGYHEKRDVEALLTFRKGITFDPHEWLSNWTANNSHNVCLWNGISCRPNTKRVVSISLPQRSLNGTLSPYIGNLSLLQQLDLSFNALSGRIPAEFGQLKALRTFEVRHNALS

SEQ ID NO: 100 - protein, 126 aa, Eucalyptus grandis
MASCGGLVSTFLLAIFVTQIVEFSHSIASTNVSCIGVEREALLKFKHGLTDPWKRLSSWTGEECCKWEGVECNEKTGHVLKLDLHNPCIEEIDMLEPSYKCRLGGNIVHSLTELKYLKHLDLSINN

SEQ ID NO: 101 - protein, 128 aa, Eucalyptus grandis
MCSRRVVSSMETNPIHLIYHVFFIVIGLVSVSAAEQSASSRKTDAEALILFKKMIQKDPSGVLSGWQLDQDLCAWYGVTCYSGRVTQLDLHGQSLEATMSFDPLSSLDMLTVSICHQTRSPSIQLPCF

SEQ ID NO: 102 - protein, 128 aa, Pinus radiata
MDLLLLLLVMMGVAMPTHSQRFPFNGRSMMGKPSLFPSSIAGYHEKRDVEALLSFRKGIISDPHGSLSDWTANNSHNVCLWNGISCRPNTNRVVSISLPYCRLSGTLSPYIGNLSLLRYLYLSNNDLS

SEQ ID NO: 103 - protein, 153 aa, Pinus radiata
MRSVFRISSLLVISILVLLTLSSAINDDAEMLLAFKSAMSDPDGALAGWTESDAANFCGWTGVLCNEFNRTSSLDLTNMNLSGIIPPRTLSSLDSLVNLSLALNKFSTPFPSAILDISTLRFLNISNNNFSGEIPANISRLVNLELLDTYNNN

SEQ ID NO: 104 - protein, 173 aa, Pinus radiata
MAPLLGILLLHALIFSYGEEAHVAGSNHTEVRALMALKAGIVDTSGHLSDWEVHGDELSASPCSWTGVFCDLESENVTELDLSRMNLTGTISDEIRELQHLKVLNISFNQFSGAFPVVIFNLTRLRSLDINHNSFEGYFPAGISKMKNLVNFIAFSNSFKGPLPLEFVEMLFW

SEQ ID NO: 105 - protein, 247 aa, Eucalyptus grandis
MAAPSSSAASAAVFALHSLLLLLLLAAAVEDDVLCLEGVKRSLGDPQGSLADWTFANTSASHICNLNGVACWNLNENRIISLSLTGFGVSGGLPESLKNCHSLQTLDLSQNKLDGPIPAQICEWLPYLVKLDLSSNSLAGPIPSQIGDCKFLNNLILNDNKLTGPIPYEVGRLDRLKVFSVRGNDLSGSIPSELSKFSSDDFSDNDDLCGRPLGSCGGLSKKSLAIIIAAGVLGAAASLLLGFALWW

SEQ ID NO: 106 - protein, 145 aa, Pinus radiata
MDLLLLLVMMFVCSVMMGVAMPTDGFTSVESVPFNGRNRHKRDVEALLSFKESIISDPYGSLTNWTANNSHNVCLWNGISCRPNTKRVVSISLPECWLNGTLSPYIGNLSLLRHLDLSWNALSGRIPAEFGQLKALRILDLSASH

SEQ ID NO: 107 - protein, 150 aa, Pinus radiata
MAPSTDFILITSTLMLIFVSANAHLLHHYHEKSRERLQVDIEALQAFKASLTYDPSHALANWDFVANHVCNWTGVTCNPHKLRVSALNLYNMSLQGTIPPHLGNISFLGVLNLTLNSFSGIIPNELGKLRRLKRLSLKQNQLISSIPRLK

SEQ ID NO: 108 - protein, 126 aa, Pinus radiata
MRMFLLLVYLFPLVTPFAFSTVQLSNGSNAVDQEAVLGFLSAITNDPYQSLPTNWKSNVSVCEWTIIKCNGSRVVSLNVSSMGLEGTISPLLGNLSFLEKLDLRNNNFHGPIPYQLGSLVRLQMLI

SEQ ID NO: 109 - protein, 118 aa, Eucalyptus grandis
MESCNCVEPQWPADELLMKYQYLSDFFIALAYFSIPLELIYFVKKSAVFPYRWVLVQFGAFIVLCGATHLINLWTFAIHSRTVAYVMTIAKVLTAAVSCITALMLVHIIPDLLSVKTR

SEQ ID NO: 110 - protein, 132 aa, Pinus radiata
FVSNAHFYLKVQVKDSGCGIQPQDIPQIFTRFIHPRSGSNRGNGSGGLGLAICKRFINLMGGHISIESEGHDKGTIVTFVVKLQKCSNANDSAAHEITSRAQSIHESTHFARHKPLIDTDRTVPSSSQYQRS

SEQ ID NO: 111 - protein, 117 aa, Pinus radiata
ILSKRWYALMVLMLPSDSARRWHVHELELVEVVADQVAVALSHAAILEESMRARDLLMEQNVALEIARQEAETAIRARNDFLAVMNHEMRTPMHAIIALSSLLQETELTPEQRSMVE

SEQ ID NO: 112 - protein, 232 aa, Pinus radiata
VATPSSHSCSSFPLLPSTTVTTRDRSASNASSSSGTSSTCVSTSYGAIATGSDNAAIEGSPPAAVAAAIMTPSSDQHHHLHAPQPINVGNTCAVAMDTLAQHSCSSGMASPPSTPTGITNVARLTMRAGAGGDGDSHALALGSDPIATQSPSTKRRAASAPWPWAYTRVPIVAATAGALEEEQKECIQAGMDDVLTKPIDRYQLQRKLARFSPRFTSLVVASSAPASQQAHQ

SEQ ID NO: 113 - protein, 166 aa, Pinus radiata
TRVLLIDDHPLFREGLAGAIQAEPDFEVVGQAGTVDELRGLAPQIEPDVAIVDLLMPSVSGIGVTRELCELLPRCRVLGLSAVVDAAAIAEMLRAGASGFALKTQPAPDILDAVRRTVAGESYLPPSVSREAIDAELAGGAPPSLAQLTKARARDLRADDPRLHQS

SEQ ID NO: 114 - protein, 762 aa, Pinus radiata
MICLGGIVIVSFLLQNIAMASEDGGSRCNCDGEGWWNVENIMQCQMVSDFLIALAYFSIPLELLYFLSCSNSLPFRWVIVQFGAFIVLCGLTHFINIWTYGPQSFHVMLALTIFKFLTALVSCATAITLVTLIPELLRVKVREIFLKNKARELDREVDIVKRKEETSWHVHMLTQEIRSSLDRHTILNTTLISLAKTLNLENCTIWMPLADGTAMEVSHELKRRHLQVPLTVPTTDPDVKKIMHSEDAILLSPDSALGKESNHHWSLAGPVAAIRVPLWKASNFKSGASVDREESYAIMVLVLPCEDERQWSSQELYIVKDVAEQVAVALSHAAVLEESQKLKAPLIDKNKTLQQAKQDALRASKARHSFQLAMNREMRLPMHAISALSSILQSARLNVEQLAMTNMLAKSSSLLSTLINDIMDFSELEDTSLVLQLHPFQLHGMLKDAAHLTETMSRSKGLLLNVEIGDGMPDHVIGDEKRILRIILHMVGNAINSTKQGTISIRICVEDRAEGWWDPNNRRWRPSLCEGFTYLRFEIRTSGSGSIQNDNPSFLTVVQDGKSDSSSSTGEGLGFAICKKFVQLMHGNIWLEPNSKGEGSVVTFLIRVQLQTSTANKHWLSPDEKIYKSSFKGLKVLVADDNNVSRSVTRRLLQELGCQTTEVDSGYRCLMTLLQSGSAFQLVFLEVCLAQMDGYEVAFRIRQKFRSRNRPLVVALTASTDKETMERCLQTGMDGVIRKPVTLREMSNELFKIVHQTNNIHE

SEQ ID NO: 115 - protein, 158 aa, Eucalyptus grandis
TMRAKQMLATMSHEIRSPLAGVVSMAEILAQTRLDHEQRQLLDVMLSSGDLVLQLINDILDLSKVESGVMKLEATKFRPREVVKHVLQTAAASLRKILTLEGHVADDVPIEVIGDVLRIRQILTNLISNAIKFTHEGKVGINLYVVPEPSVEKTEECP

SEQ ID NO: 116 - protein, 170 aa, Eucalyptus grandis
KIEIEAVQFDLRAILDDVLSLFSGKSQEKRVELAVYISENVPEKLIGDPGRFRQIITNLMGNSIKFTEKGHILVTVHLVDEVMNSTDAEMESATRSTLSGFPVPDRRLSWAKFRTFSQEGPASPVPSSFSNPINLIISVEDTGIGIPPEAQPRVFTRFMQVGPSISRTHG

SEQ ID NO: 117 - protein, 599 aa, Eucalyptus grandis
LEHKISISSLKTKLKQHGSHARRASKKDNKVTLWFEVDDTGCGIDPSKWESVFESFEQADPSTTRLHGGTGLGLCIVRTLVNKMGGEIKVIKKNGPGTLMRLYLLLNAPVDGTEHNCSVDYAVHNIRVLLAQHGSTGRFIMSGWLRRNGVSTLEASGWNELTQILQELYQGRNSGAPYRTVNTEHAHELPRSEVTTFDDIQSEILIIVVDIELLDLNTDIWKEQLNFLDKYHRKAKFAWMLNHDTFNAIKVELRRKGHMLMVNKPLYKAKMIQILDAAIKERNSELLKRASNSSKSMNKEEDLHECLEIDSEHYEGASSDELDTVETSRSGCTNTSPGEQKQQEGIKTPPALQHRTSNYHSFNSTLLSSDYNNLGNKEEACPTSPPLDHPDNAEGRFKCTRSVFSSKEKEDGNSEAQEQLLISKRPPAKVDSCSSKELDQKGSLEGLCILLAEDTPVLQRVATIMLEKLGAKVIAVGDGLQAVNALNSSLDVDAEDFRTTLHLQNANRMPQAGTRSWQPYDLILMDCQMPQMDGYEATKAIRRSEAGSGLHIPIVALTAHAMSSDEAKCLEVGMDAYLTKPIDYKLMVSTILSLTKGVN

SEQ ID NO: 118 - protein, 153 aa, Eucalyptus grandis
LSTGASSATTGMASNGLVSPRRRSSGQFDGSDPSPCGSEEVHVLAVDDSLVDRKVIERLLKITSCKVTAVDSGLRALRYLGLDEEKTAGDFNGLKVDMIITDYCMPGMTGYELLKKIKESSALREIPVVIMSSENVLARIDRCMEEGAEDFIV

SEQ ID NO: 119 - protein, 190 aa, Eucalyptus grandis
IISSCASSVKTGMARNGVASWRRRSSDQFDDPSPCGSEDVHVLAVDDSLVDRKVIEHLLKISSCKVTAVDSGIRALQFLGLDEEKAAGDFNGLKVDLIITDYCMPGMTGYELLKKIKESSALREIPVVIMSSENVLARIDRCLEEGAEDFIVKPVKLSDVKRLRDFMTRDVGDRVRSDGEGTTHKRKLQE

SEQ ID NO: 120 - protein, 206 aa, Pinus radiata
AAASTEDTGIGIPLPAQHRVFTPFMQADSSTSRTYGGTGIGLSISRCLIELMGGEIRFISRPGIGSTFSFTALFKVGQAGADGDGDLLRGARLPTHFKGMKALVLDGNPVCSLVTKYHLQRFGIEVDSITSSKVALSMLNGMDGFPTEGCSVKDGIDMVLIEKDAWGSRHWHLISFASTSRSLSKRTLSTVKGFIKDDSFGYIADS

SEQ ID NO: 121 - protein, 123 aa, Pinus radiata
SKGLLKIILLATSLTAEETQKAKAAGFAETVILKPLRASVFAVRLQLALGFCYRREHLREPLKTSSPLSNVLSGKGILVVDDNIVNRRVAAGALKKYGANVICTDGGKSAISMLRQPHNLITS

SEQ ID NO: 122 - protein, 142 aa, Eucalyptus grandis
MASNGLVSPRRRSSDQFDGSDPSPCGSEEVHVLAVDDSLVDRKVIERLLKITSCKVTAVDSGLRALRYLGLDEEKTAGDFNGLKVDMIITDYCMPGMTGYELLKKIKESSALREIPVVIMSSENVLARIDRCMEEGAEDFIV

SEQ ID NO: 123 - protein, 146 aa, Eucalyptus grandis
CSFTLSSSSPLFLAVVLGRSPIEMGVTAASQFHVLAVDDSLIDRKLIERLLKTSSYQVTAVDSGSKALEFLGLNEQQPRNANATSVSPSYHHQEIEVNLIITDYFMPEMTGYDLLRKIKESNSYKDVPVVIMSSENVPSRISQCLE

SEQ ID NO: 124 - protein, 426 aa, Eucalyptus grandis
GKLAVYVSDRVPEAVIGDPGRFRQIITNLVGNSIKFTHEGHIFVSVHLLEEGCSQHDFRDVEKRLSSNLVEDTSDKTFNTLSGFQVVDRRKSWERFKKLNRSDQIDVNESVEVLVTVEDTGVGIAREAQSRIFTPFVQADSSTSRTYGGTGIGLSISKCLVDLMHGEIGFVSEPGTGSTFSFTVPFAKCEMNCLEVKGQNYDSIISEFRGLRALVIDKRHIRAEVARYHLERLRISVDVACSLKSACTYLSNSSSPRELSDFDMVLIDKDVWDRQTGLELNISLWKHRQNGSNGVSIRPKIFLLATSISPIEHSELKLANLVDNVLAKPLRLSVLISFLQEALGNGKKRLSDRRKVSTLGSLLKGRRILVVDDNLVNRRVAEGALKKYGAIVTCVGSGKDAVAKLQPPHDFAACFMDLQMPEMDGF

SEQ ID NO: 125 - protein, 107 aa, Eucalyptus grandis
MMESSKGFSSPRSNGFPAGLRVLVVDDDPTWLKILEKMLKKCSYEVTTCGLARDALKLLRERKGGYDIVISDVNMPDMDGFKLLELVGLEMDLPVIMMSVDGETSRV

SEQ ID NO: 126 - protein, 121 aa, Pinus radiata
MVTSRMSSAMRMKKEKNAACGEHGDELVRCDEMHVLAVDDCLIERKVIEKLLKTNFFKVTSVDSAERALEVLGFHEEQSTCATTNAFKVNMIITDYCMPGMTGYDLLKKVKETKCLKEIPG

SEQ ID NO: 127 - protein, 261 aa, Pinus radiata
MAVSQHLFLSAQRLNGREDEGSLYLLRAGVNWDLLIMGVALVACLAILGMVWKRRRTWSYCEGLQEEDAGQRAQETQCSKGFMTNVFHNTRDCRSEQIIWDDIHISSQTETRSQKVRTVKSKSSMISRDSCSSPRRILLVEDTQINRIIFGRVLQSLNLYCEEAENGKVAVDYFKQGRTYDLVLMDKEMPVMDGHEATRQLRSMGVKTPIVALTANTLQSDKDLFFEAGVDDFQSKPLSRDRLVQLLDQYGVDGCAGNRRG

SEQ ID NO: 128 - protein, 120 aa, Pinus radiata
GYLGSTSSVQPVNFYLFWFIEVAVPQHLVLGHQYLSGTEGGDGLYFLRAGLNWVLLIMGVALVACLAIFGMVWKRRRTWSYCGAMQKEDASQRAQEAQCSKGCMTNVLPNTRACRGAHII

SEQ ID NO: 129 - protein, 214 aa, Pinus radiata
KRFLEGHELSYLRAIGVIILSAVLKRRMILADKAKSLFISNISHELRTPLHGILAAAELLGDSPLNHSQLSFLETVQACGTSLVETVNHVLDFTKLSGNSKAGGVEKVIVPTRVDLMQLIEEAVDGCWIGHRARTAIMGDTGIGSVYSPPEDLSSPKQLVETVVDIGWRKKGWSLKCEKGGIRRVLMNVFGNSLKFTTNGYVHVILRELPRSGD

SEQ ID NO: 130 - protein, 224 aa, Eucalyptus grandis
MTMAGEILRRQSPAEVDLCGGSGQELHVLAVDDSLVDRKVIEKLLKRLSCKVTAVDSGLRALQFLGLDGEKSSVGLDDLKVNLIMTDYSMPGMTGYELLKKIKESSAFRETPVVIMSSERILARINRCLEEGAEEFLAKPVQLSDVQRLKNFVMGGGEVCPDRRINKRRLEENNDNDDNENHAPSPVSPLCSRDWAVCSSSSSDSSSPSIAVSSSKRLKIHHQA

SEQ ID NO: 131 - DNA, 359 bp, Eucalyptus grandis
catgaggagggtggaaagatttgtgatgatagcattgtggtgagtgacgaggaggcatcaaacgacatgaggagggtggaaagatttgtgatgatagcattgtggtgcatccaggaaaacccggctttgaggccaaccatgaagaaaattactcagatgttggaaggagctgttgaagtcccagtacctccatttccaagctcttttatgagttcaatatgattttgcttatttaagatcacttttgtctgtaatcatgaaagtactcgtattgtctgtaagtgctattatttatactgtcttcacatgggtcccaattaaataagctatatcatcagtcaagtttaacaaaaaaaaaa

SEQ ID NO: 132 - DNA, 765 bp, Eucalyptus grandis
gcgtacaccactggactgggagaaccggcttaagattgcaattgccacgggaagaggcctagcacaccttcacgcggctggcaaggtggtccatggcaacatcaagtcctccaatgtcttgctccggcccgaccacaatgcctgcgtctcagattttggactgaaccctttgtttggcaccgcggccccgcccaatcgggttgctggttaccgggcccctgaggttgtggagacccggagggtcacgttccaatccgatgtgtacagcttcggggtcttgttgctggagctgttgacgggcaaagcacccaatcaggcctcccttggggaagagggcatcgacctgcccaggtgggtccagtcggtcgtgcgcgaggagtggacggccgaggtcttcgacgtggagctcatgaggtaccagaacatcgaggaggagatggtgcagctgctgcagattgccatgtcctgcgttgcggttgcgcccgaccagagaccgcccatggtggaggtggtccggatgatggaggagatgaaccggggcgagacagacgacgggctaaggcagtcctcagatgacccgtcgaaaggatcggacggccagaccccgcccacggagtcgaggacgccacccattggcatcacgccttaaagctcaaagctttaaaaaacattcttgcgatttattgagttgggttttttcctcagaaaagtgcacagggggagtaaataacagattttcaagtttccatccaaaaaaaaaaaaaa

SEQ ID NO: 133 - DNA, 402 bp, Eucalyptus grandis
gtaaaaatcaatgaaggatttgaccgcttcttcgaaagggagctcgagattcttggaagcataaaacatcggcatttggtgaatttgaggggatattgtaattctcctacggcgaaattactgatttatgacttcttatctggtggtagccttgatgaagcactgcacgaaagatccgagcaattagactgggagacacgttgtaatatcattgtaggagccgctaaaggacttgcttatctgcaccatgattgctccccaagaatcattcaccgtgacataaagtcgagcaatattttgcttgatggtaatttggaggcacgagtatctgactttgggcttgctaaattattggaggatgaggagtctcacattacaaccattgttgctggaacatttggt

SEQ ID NO: 134 - DNA, 399 bp, Eucalyptus grandis
ggaatgctgggggtcaagtctgatatatactctctagggatcatctttttgcagctattaaccgccaaacctcccatgggattgacccaccatgtcgagcgggcaatcgagaatgggacttttgctgaaatgctagatccagcggtgcctgattggccctataatgaggctctggcctttgcccaaatggcacttaagtgtgcggagttaagacggaaggatagaccagatctcgcaaaagtcattctccccgaacttgacagactgaaagcattggctgagagaaggattcatccctcgtggcctggttataactcgagcgactcacccaatgacagccaggtttctttgcaactgggttcaatgagttctccatcactcggggaatcgcattgcagt

SEQ ID NO: 135 - DNA, 349 bp, Eucalyptus grandis
cttagactccgactaccaacccaaagttgcggattttgggctttccaagctaatggaccgagggaaggtgaggaattctgatttctcaagaattagaggaacccgagggtacatggctcccgaatggatctcaaatctgcccatcacatccaaggtggacgtctatagctatgggattgtcatgttagagatggtgaccggaattagcccgatgacaagtgtccaatcattgccgagcggaggggatgccaagcaaatctggcttgtcccgtgggtgaggaataagataaaggggccacggaggacagggtcccgtctgaaagagatggtgcatcctgagctcaggggc

SEQ ID NO: 136 - DNA, 430 bp, Eucalyptus grandis
tgggaagccagctttggactggtcaaggcgaaagaggattgccttaggtacagctaggggattggtttatttacatgaacagtgcgaccccaaaattattcaccgtgatgttaaagcagccaatattttgctcgatgaagactttgaggctgttgttggagattttgggttggcaaagcttttggatcacagggactcccatgtgacaacagcggtgcgtggcacagtaggccatattgctcctgagtacttatcaacaggccaatcatctgaaaaaacagatgtatttggatttggtatcctgctcctcgagctcatcactggtcaaaaagctctagattttgggcgagtagcaaaccagaaaggagtcatgcttgattgggtaacaaagacacaaaaggatggaaaactaaaccaactggtagataaa

SEQ ID NO: 137 - DNA, 367 bp, Eucalyptus grandis
gatgctttaagtggtttaaagattctggatattagcaataacaaaatctctggtgaaatcccacaaactttggctgggtggaaatctctggagatagtggatttaagctccaacaacctctctgggacattgaatgatgcgataaccaaatggtcaagcctcaagtatctgtccttggctcgaaatatgtttagtggaaatctgccaagctgggtattcacattccaagcaattcggatgatggatttctcaggaaataatttctcaggcatcataccagatggtaacttcaacctaagtttgtattacaacaacagagattttgctagacagccaggtaatatctcattggtttccatggaaccct

SEQ ID NO: 138 - DNA, 260 bp, Eucalyptus grandis
cattgatcgtcacaatcattcgatgaagaggatttcgcaaagaagcccgttcctgtcaaaaaagctattaaacttcctacaaacttgacttcatattcaatagcagacttgcagatgactacaggcagcttcagtgttgataaccttcttggtgaggggtcctttggacgtgtttatcgggctcaatttgatgatgggaaggttcttgccgtgaagaaactagattcaactgcccttccaaatgaactttctgaagaatt

SEQ ID NO: 139 - DNA, 335 bp, Eucalyptus grandis
gagggttgccgaatatttgcgaattcaatggcgaatactcggtggcggctgctgctgcggctgcgatgactgtaccaactggaaggaaagaagcaaatggcggaggagcaagaaatcttgttttctttgggaaaatggcgagggccttcgatttggaggacttgctgagggcatcagcggaagtcttggggaaagggacatttgggacttcttacaaggcggtcctggagatgggaaacatggttgcggtgaagaggcttaaggatgtgaacattgcagtgggggaattcaaggaaaagattgaagctgtaggagcgatgaatcacgagcattta

SEQ ID NO: 140 - DNA, 740 bp, Eucalyptus grandis
ctcgcaccagctgttgtatagcgcgtaggaaaggaaatccaccgccgtctcgctcgttgactcgactcgactcgactcccccatcttaactcgctccgcttgaacgtcgttgtgaaatcgtctctgctcccgtcctgctctgcgaagatggaggcgttcccgaagctcgatccccgctccttcttgctgctctgcgcgtgcgctctccccgcgcttgccctctcctttcccttctctcccctcgacaattacctcctgaactgcggctcctccgtcgacgccgtcgtcgacaaccgcgccttcctcggcgacgcgcccggctccggtggctcccgggtcctggcctcgacccggacgatctcgctcaacgacgccagcccggccctcggcacgccccaaatctaccacacggcgagggccttcgccaggccttccaagtacgtgttcgaagtccgggacagagggacgcacatggtacgccttcatttccataggttcgattcctcgagggtggagttgggggacgttcgatttcatgttttggtggatgggtatgtggtgctgagtaattttagcggtgaaagcgcgtctaggcccgtaattaaggagtatctgatctgggtcgatgctgaaaagcttgttcttacgtttgtgcccgctggaaggtcgaaatttggatttgtcaatgcgattgaagtgatttctgcgcccaaagatttgattttggagactgcccagct

SEQ ID NO: 141 - DNA, 619 bp, Eucalyptus grandis
gcaccatcacgcatgtgaatcttgttaggctccgtgggttctgctcggagggtgacaaaaggctgttggcctacgatttcatgccaaatggttccttagagtatcatctctttcatagaaaggacttgaagaccttggattggaaaacgaggtaccaaattgctttgggaacggctcgaggtctggcttatctccatgagaagtgtagagactgcatcatacattgcgacatcaagccagagaacatccttctagatgctgaattctgtccaaaagtggcagattttggcctggcaaagcttgttggccgagaattcagcagggtattgacgaccatgagaggcacaagagggtatcttgcgccggagtggatctctggggtggccataacagcaaaagctgatgtttatagctatggaatgatgctttttgagtttgtgtcgggaaggaggaacgcagagctatcggaaaatggggcggtcaagttcttcccaacatcggctgctagtaaattagccgaaggaggtgacctgcttgatcttttggacccaaacttggaggcaaatgccgatactgaggagctaaccaggctttgcagagttgcttgttggtgtgtcca

SEQ ID NO: 142 - DNA, 613 bp, Eucalyptus grandis
gttgtgtttcggatgttggactgactcctctcatgaatttgtctgcaataactccccgagttattgggtactatgctccggaggtgattgaatcaaggaaagttactcagaaatctgatgtttacagctttggtgtgctccttcttgaaatgctaacaggtaaaacacctctcaagcatccgggactcgatgacgtcattgatcttcccaggtgggtccggtcagtagttcgagaggaatggacggctgaggtctttgatgtcgagctgctgaagtacgagaatgtggaggaggagatggtgcagatgctgcaaattgctctcacgtgtgtcacaaaggtacctgatatgcgccccaagatggatgaagttgccaggttgattgatgaagttcgggaaccagaggcaaaggatcggccttcttctggagctgaatccaatgcgcaaaccccgtaataacagattttagattctccttttccttccctggagttgagctgcagtatctaagagagcaatttgctctcttgtaagctgtgatttacttgtatgctttgccctgtagttgaattctgtatggttttttatccattttagtgaagtgctagtctgtt

SEQ ID NO: 143 - DNA, 359 bp, Eucalyptus grandis
gccaagtacagaattgtgatgggtgttgcaaggggcctctgtttcctccaccatgattgttatcctgctattccccatggagacttgaagtcgagtaatgtggtgtttgatgagaatatggaaccgcgtttgacagagtttggactcacttatctggtccggatgaacaagggttcaatggggggaacagtttctaacctggaagcagataacaatgccatacgggagcagctccaaatggatgtttacaactttggggagatcattctagaaattttgacgaacggaaggtcagcaaatgcggtgggaagcatacggagcaagccgagggatgttcttgtgagggaaatcctcataga

SEQ ID NO: 144 - DNA, 517 bp, Eucalyptus grandis
gtatgctaacacctcagagcgatgtatacagctttggagttgtcctggtggagttactcacgagaaagaaactttctgttactgagtccgaaaagtcgatcaatattatccaatgtttcatctcttctgtgaagggcgacacaccctccgatgtcatagactttgagggcgctagtgaagatgaaattgagagagtacgaactgtagctaagattgcagtgaagtgcttggaccaaagcggtgcgaacaggccagcaatgagccatgtggctcagcaactcgctagtgtcaacccgagctcgatagttgaagaagagaatgaagagcccaaacgggaagtggatgcagaagaactctcaagctgtctttcctgcctgggaatggattcagcttctttctgcatctgatcctttattaccatcgtgacatgtctgtcaatttgcctgtaaagacttctagggttgattgtgtgcttggaatatatgttatgtgtgccattttcttttggactttatat

SEQ ID NO: 145 - DNA, 392 bp, Eucalyptus grandis
agacctcatacaaggaagagcaacaaatttcaggccctttctcgtttcaaaccgattcaaccacatgggtagccgatgtaaagcaagccacatcagtcccagttgtaatatttgagaagcctttgctgaatatcacatttgccgacctcctgtctgcaacatcaaattttgaccgcggcacccttttggccgagggaaagtttgggcctgtgtacaggggattcctgcccggtggaatccatgtagctgtcaaagttttggttcatggatccacgatgactgatcaagaagtggccagggagctcgagtatctcggtcggatcaaacacccgaatcttgtcccactaactggatactgcttagccggggatcagaggattgccatatatgat

SEQ ID NO: 146 - DNA, 469 bp, Eucalyptus grandis
ggttcttggacccgatagggcggggcgggttcggcgatgtgtacaagggcgagctgagcgacaagagggtcgtcgccgtcaagtgcctcaagaacgtggccggcggcgacgccgagttctgggcggaggtcaccatcatcgcccggatgcaccacctcaacctggtgaggctgtgggggttctgcgccgagaaggggcagaggatcctggtgtacgagtacgtcccgaacggatcgctcgacaagttcctgttccggtcgagccgcgccacggaccaaagtgagacgggcgaggccgccgccgggaccgatcagaagccgatgctcgactggggcgtgcggtaccggattgccctcggggtggcccgggccatcgcgtacctgcacgaggagtgcctcgaatgggtgctccactgcgacatcaagccggagaacatcctcctaggggacgacttctgtcccaagatatc

SEQ ID NO: 147 - DNA, 342 bp, Eucalyptus grandis
gatcagcaatttgagcaatctcctgcaattggacgtctctcagaacggtctcaccggcgtcctgccggagaagatcgctgcatatccgttcacgtccctgaacctaaatgacaacttatttaacggcgagattcccgcggttctggcgtcgaacccaaaattgcagcagctgaagctcttcaacaactctttcaccgggaaattaccagccgatttgggcaagaattccgacttggtggagttcgacgtctcgagcaactctttcaccggcgagttgcctgagaacctctgttccggaggcaagctccaggagattatggcttcaacaatcgcttcacagga

SEQ ID NO: 148 - DNA, 349 bp, Eucalyptus grandis
cggcaatcgggtcgcccggatccagataggtatgcggggcgtgtccgggaccctgcctccggacatcagcagcctcactgagctgacgcggtttgaggtcatgaacagccagttctccggccccctcccgagtttcgccgggttggctcagttgcaggtgttgcttctaaaccgcaacaatttcacctccattcctgcggacttcttcactggtatgtcgtctttgcaagcggttgacctgagctataacgacttcgctgcttgggggattcccgctagcctgaaagattgcatctcccttcagaatttcaccgcgacccaagcgaacgtgatcgggcaaatccccgat

SEQ ID NO: 149 - DNA, 515 bp, Eucalyptus grandis
gcggctccagatctgcacgggagccgcgcgtgggctgcactacctccacaccggtgccaagcagaccattatacaccgcgacatgaagaccaccaacatcctgctcgacgagaagtgggttgccaaggtgtccgacttcgggctctcgaaggtcgggccgacgtcggtgtccaaggcccacgtcagcaccgtggtgaagggcaccttcgggtacctggatccagagtactacaggcgccagcagctgactgacaagtccgacgtgtactccttcggggtggtgctattcgaggtgctgtgtgcaaggcctgccgtgaaccggacggctcagaaaaagcagatcagcctggccgcctgggcccagagctgctgtaagagcgggagcatcgacaagatcgtggacccacacctgaagggggcgattgcccccgagtgcctcaataagttctgcgagatcgccatgagctgcttgcaggacgagggaaccaagcggccatccatgaatgacgtcgtgt

SEQ ID NO: 150 - DNA, 627 bp, Eucalyptus grandis
gaggatgaggcagaccggggcggtggagcacgagaacctggtggggctgagggcctattactacaacaaggacgagaggcttctcgtttatgagtacctgcccatcggaagcctgtccgcgcttttacatggaaactccgtagtcggcaggactccacttaattgggacacccgatgtgacattgcccttggtgcggcccgtggaatcgcccacctccactcccaggacgccgtgacatcccacggcaacatcaagtcatccaacgtcctcctcaccaagtcctataaagcccgggtctccgacttcagccttgctcccattgcgaacctcattgcagctcccaaccgcatcgacggctatcgcgcaccggaggtgacggactaccacaaggtgtctcaaaaggccgatgtgtacagcttcggcgtgttgctgctagagctgctgacaggcaaggcgcccacgcattcgctgctgaacgaggaaggagtggacctcccgaggtgggtgcagtcggtggtcaaggaggagtggactgctgaagtgttcgacgacgagctactcaggtaccaggatgtcgaggaggacatggtcgagctcttgcagcttgcgatgcattgcgctgctca

SEQ ID NO: 151 - DNA, 593 bp, Eucalyptus grandis
cgggagcttgttctggctcctccacggcaaccggggtgtaggcaggacgccgctggactggaccacccgcctcaagctcgcggtgggggcggcccgtggcctggccttcatccacagctcgtgcaagtccctcaagctcatccatggcaacgtcaagtccaccaacatcctcatcgaccatgccgggaacgcccgcgtctcggactacggcctctccatcttcgcctctcctgccgctgctccccggcccaatggctaccgcgcgcctgaggtgacggacggcaaccgtggcggcggcggtgttgggaagatcacacagaagtcagacgtatactcattcggggtcgtcctcctggagctgctgactgggaagtgcccatccgtgccagaccacgggagcggggctgagtatggcagtggggccgtcctggacctcccacggtgggtccagtcggtagtgagggaggagtggacggcagaggtgttcgatctggagctgatgaggtacaaggacatcgaggaggagatggtggggctgctccagatcgcaatggcctgcacctgcgcctcccctgaccagcggccaaggatgg

SEQ ID NO: 152 - DNA, 454 bp, Eucalyptus grandis
ggcacgaggggatacacgtcgcaagataataatgggtgtcgcccgagggatgctttatctacacgaagactctccacttcgtattatccatcgagatctcaaagctagcaatgttttattagactcagaaatgaatccaaagatatcggattttggtatggcgaggctgttcgagttggatcaaactcgggccaagacaaaccgaatcgtggggacctatggatatatggcgccggagtatccaaggcacggaactttctcaatcaagtcagatgtgttcagttttggagtgctagttttggagatggtaagtggtcaaaggaacgctctttttcgcatgggtgatgacacggaagtccttataagctatgtctggaagaattggagggaaggatcattatcaaatattatcgatccctctatacttctgggtcaaatattggaaattgcaagg

SEQ ID NO: 153 - DNA, 594 bp, Eucalyptus grandis
cgggaaggaggaacttagagctatcggaaaatggggccatcgagttcttcccaacatgggctgctagcaagatagctaaaggtggtgatctgcttgatcttttggacccagacttggagaaaaacgctgatactgaagagctaaataggatatgcagagttgcttgctggtgtgtccaagacgaggaaactcacaggccatcgatggggctggttgttcaagtactcgaggggttgttggatgtgaacctgcccaggataccgagagcccttcaactgcttcttgataatcaggagcatgtagttttcttcactgagtcgtcatcatcggaccagaattcccagacgaatagtaatacctcaacttcttccttgcagaacccaaatagttcatcttcgacgaagtccgagtcttgaggatgataagataaatacttagtacaagaagtgcttcagttagatagtgcatatgctcctctgttttttctgtagtcaagagcgaatctcagcatttggggattggcttcttggggcttttccccctagctatttatgttgcacgtagatacaagcaagcttggaataagtgcgcggc

SEQ ID NO: 154 - DNA, 325 bp, Eucalyptus grandis
ctttggcaaagtttacagttggtgttctctcagacaatacaaaggttgctgttaaaagactttccgatcataacagtcctggtggagagactgcattcgtgagggaagtcgagcttataagcgttgcagttcaccgtaaccttcttcgtttgattggtttctgtacgaccttctcggagaggatacttgtttatccctacatgaaaaatcttagcgttgcataccacctgagagatttaaaaccaggagaaaaagcactggcctggccaacgaggaagcgcatagcttttggagcagctcatggcctggagtatcttcatgaaca

SEQ ID NO: 155 - DNA, 510 bp, Eucalyptus grandis
gcgagagagggttggggttgcggagttttgaggagagtaccacagtggtcaggttcgcatttgaggacatcaagaaggctactaggaacttctctagggattacatcataggacgaggtggatatggaaatgtttaccggggtttgttgcaggatggcactgaagtcgcgttgaagaggttcaaaaattgctctgctgcaggggatgcaaacttcgctcatgaagtcgaggtcattgccagcgtaaggcacgtgaatctggtcgctcttcgagggtattgtattgccacgacacagtacgagggtcaccagaggatcattgtgtgtgatctgatgagaaatggaagtttgcatgaccatttgtttgggtcgaccgagataaagctcagttggcctactcgtcaaagggttgcgctcggaacggccagggggttagcttatttgcattacggggcacaacctggaatcatacatagggatattaaggcaagtaatatacttttggatgaga

SEQ ID NO: 156 - DNA, 459 bp, Eucalyptus grandis
aacgattgcaacccgtccatcatccatagagacatcaagactacaaatatcttgttgaatgaaaacatgcaagccaaaatatctgacttcggtctgtcgagaccttcagcagctgcaaatggttcttacatgtcaaccagtcctttgggcacttgtgcctacctcccccctgagtatgaaccagttgctcatgaaataaacaagaaaagtgacgtctacagttttgggatcgtgctccttgaactaatttcaggacatgtagtcatcaatacaatgggagatggaaaaagcgtgcacatatgtgaatgggcgattccgaagttcaaaaaaggaaatatacgcagacttattgatccaaaggtggaagaaaaattcgacatcgactcggccaagatagcagcgaaagttgcggagtcttgtcgcaacaaaaaccagatgccagggccgacatatattggg

SEQ ID NO: 157 - DNA, 428 bp, Eucalyptus grandis
gtgttgcgggcgaatgccgacttggccggcgacaagcaagccctgctcgatttcgccgacaatttgccgcactctcggtacctgaactggaccgagagttcccccgtttgcagcaactgggtcggagtgacctgcgacaaagatgggtccagggtgatagccttgaggttacccggcgtcggatttcacggcccgattccggccaacacgctcggccgcctctcggatttgcagatcctcagcctccggtcgaatgccataaccgggagtttcccgtccgatttcgccaacttgaaaaacctgtcgtatctctatcttcagtccaacaagttctctggccctttgccttgggacttctctgtttggaagaacttgactatcttgaatctttccaacaatgccttcaatggaagcatcccttcttcgct

SEQ ID NO: 158 - DNA, 471 bp, Eucalyptus grandis
caagattggggagcagagatgggacatgccctcacttcagatgctaaatttggcaaggaatggattttcagggaatttgcctgaggactttgggagtgaaactcttgagaatctagacttgtctgaaaatgggttctcagggacaattcctaggagttatgggacaatatcagagttgatgcaactgaatctgaacaacaacaagctcttcggcaatatccctgaagagttgtcctcatgcaagaagcttgtaaccctagacttgagctccaaccaactcagcggcccaatccctgcgagtatctccaacatgccggtcctcggtgacctcgacctctctgagaatggattgtccggcaagatcccatcaaacttagggaatgtccagtcacttgttcaggtaaatatatcccacaatcgcttgcgtggcagcttaccacccactggagcatttctcgccatcaacccaag

SEQ ID NO: 159 - DNA, 1457 bp, Eucalyptus grandis
cacctattggtctgtctaggctctaaccatgcggagaagtttgtcaagatacttcacgacagtagcttgaatttcaagtactctacccttgagaaggccacgggatcttttgacagcgccaataagctcggccaaggtggatttggcactgtctataagggagttcttcctgatggaagggagatagctgtgaaaaggctcttcttcaacaataggcatagagcagctgacttctacaatgaagtgaacattataagcagtgtggagcacaaaaatctggtcagattgttgggatgtagttgctcgggacctgaaagccttcttgtctatgagttcctccccaacaggagtctcgaccgtttcattttcgatgcaaacaaaggaaaggcattaaactgggaaaagagagtggatattatggttgggactgcagagggtttggtatatcttcatgaaaacttcaagaacaagataattcacagggacataaaagcgagtaatatcttgttagactcaaaactccgcgctaaaatagctgattttgggttggccagatctttccaggaagataagagtcacataagcacagccattgctggaacattgggatatatggctccagagtacctagcacatggtcagcttacagagaaagcagacgtctacagctatggtgttctcttgctggagacagttacaggaagacagaacaacagaagcaaaaacttagaatactcagagagcctcatcacaattgcatggaaccatttccaagcaaacagagtggaggagcttttcgacccgagcttgatgttacataaccaccacaatagaaacatcaagaatgaggtcttgagagtcatccatataggactattgtgcacacaagaggctccttctttgcggccaacaatgtccgaggcattgcagatgctaacaaagaagaatgaagaactcccaccacccaccaatcccccttttatagatgaaaggacaatggagctcaatgatgcgtgtgacgacccatcttttccactgaaccctaaaacatcagattcaattgccaccatatcgaacagttccttccagcctaggtgaattgtggatatctattagtggccagtacctcacctgactaataaagatacactatggagagcaggggctggccctatttggcctaatgacgcaagcatccagatagggaacatagtggtgaccatcagagaaagggcaagtcaacaagcagttgaagcgggaagatcagcaccatctaagtcatttgtagaatatcaccacttgaagttgaaggatagcttaaattgaaaagagtgcattaaggcagcttctgcaattttaaaggaaataaagggtgtatatgaacattaaatagctaaactatgcagtgtaatgttttgattgctttgtattgagtcacagactgtacaaaaaaaaaa

SEQ ID NO: 160 - DNA, 840 bp, Eucalyptus grandis
cttaggtcgatctttatacttgccgggttggtctttatcgtcggcgtcggttggttttacatgaagtataagagcttcaagaatgccaagagagctatcgacaagtcgaagtggacgctgatgtcatttcataagctgggctttagcgaagacgagatcttggattgtctcgacgaggataacgttatcggaaccggagcctctgggaaagtatacaaggttgtattgagcagtggggacgcggtcgccgtgaagaagctttgggatggacccaggaaggaaagtgagagccacgatgtcgagaagggtcatgtgcaggacgatggctttgatgctgaagttaaaactcttgggaagattcggcacaagaacatcgtgaagctctggtgctcttgcactacgagagactgtaagcttctcgtttacgagtacatgcctaacgggagcttgggcgatctgctgcatagcagtaaaggagggctgttggattggcctacgaggtaccggatcgcagtggacgccgcggaggggctctcttatctgcatcacgattgcgtgcctccgattgttcacagggatgtgaagtcgaacaacatcttgttggatgcggatttcggagcccgggtggctgatttcggagttgctaaggtggtggaacggactgggaagggccatgagtcgatgtccgtgattgctggttcttgtggctatattgctccagaatatgcatacacgctcagagtgaatgagaaaagcgacacctacagcttcggggttgttcttttagagttggtcacggggagacgtcccgtggatccagagtttggggagaaggacctg

SEQ ID NO: 161 - DNA, 435 bp, Eucalyptus grandis
gtcgctttctacgtgctcatagctctagccgtatgcgttgtgctccttttcgcgtccctggtttggttcctcaggacgaagctacattggttcggaggcaaatcgagacggttgtggaaaataaccacgttccagcgggtcaagtttagcaatgagatcgtcgatcagttaatagaggagaacaagatcgggtctggagggtcgggcgaggtctaccggattaggctcaagtcgggtcagatggtggcggtgaagaagctctgggcgaagacccaggccccggacatcgagtccatgttcaaatcggaggtggagactctgggtcacgtccgccacgccaatatagtaaagttgctgttcacgtgctcggccgaggagagcagtcttttagtctacgagtacatggagaacgggagcctgggcgacgtgctgcac

SEQ ID NO: 162 - DNA, 301 bp, Eucalyptus grandis
ggtttggtggtcctatcccggctaacctcggaaatcttccggagaaggtttatattgatctgacctacaacaatttaagtggtccgataccccagaatggcgctcttatgaatcgaggaccgactgcatttattggaaatcctgggctttgtggccctccattgaagaatccctgttctccggatactacaggtgcaactgctcctacatttccctattttccgagtaattacccacctcagtcagatgacagtgcaaggggcagtggaaaagctcgagggttgagcaagagcgctataat

SEQ ID NO: 163 - DNA, 497 bp, Eucalyptus grandis
ttcgttcggcgagaacaaggacatcgtgaagtgggtcatcgaggtcgcgttgtcggctcccgaggcggaaggggacgggaatcgtgatggcggcgagcccgggtgttgcttcggcgatctcgcgcagctcgtggatccgaggttgagcccgtcctcgagcgactatgaagagattgagaaggtcttgaacatagctctcttttgcacttccgcgttgccgaacagcaggcccaccatgaggcgcgtggttgagttgctcaaggacaagaagttcgcccgttccaaatgagatgagctgtcatttttggctctcagtttagtggtcagtgtgcatgtaaaatatatgctgggtgcatcgtcaactgtagtttgaaagtagggaaaggcttgtgagatagatcttccgctgccctctttttttacctcttcaagtgtttgggattttcattaaaagaacaatagctttcaatcgctgaataaaaaaaaaaaaaaaaaaa

SEQ ID NO: 164 - DNA, 698 bp, Eucalyptus grandis
gtctgctcaatcgtgttcgcgatcgccgcgatcctcaaagcccggtcgctgaagaaggccggcgagtcccgtgcgtggaagctgaccgcgttccagcgcctggacttcacctgcgacgacatcctggattccctgaaggaggataacatcatcgggaagggtggcgcgggcatcgtgtacaaaggcgcgatgcccaacggcgaccaggtcgccgtgaagagactgcccgccatgagccggggctcgtcccacgaccacgggttcaatgcggagattcagaccctcgggcggatccggcaccgccacatcgtgaggctgctcggcttctgctcgaaccacgagacgaacctcctggtctacgagtacatgcccaacgggagcctcggcgaggtcctgcacggcaagaaaggcgggcacctgcactgggacacgcggtaccagatcgccgtcgagtccgccaaggggctatgctatctccaccacgactgctcgccgctgatcgtccaccgggacgtgaagtcgaacaacatcctcctcgacttgaattacgaggcccacgtcgccgatttcgggctcgccaagttcctacaggactcgggtacatcggagtgcatgtccgccattgccgggtcatatggatacatagcgccagaatacgcgtacactctaaaggtggatgagaagagcgacgtctacag

SEQ ID NO: 165 - DNA, 438 bp, Eucalyptus grandis
ccgcagctggaggtgctgcagctgtgggagaacaacttcaccggcagcatcccggagaagctcggagcgaacgggaaattccactttctcgatctctcctccaacaaattgaccggcactctgcctcccgatatgtgcaagggcaataagctcagcacattgatcacgctcgggaatttcttgttcggcccgatcccggaatcgctcggcgagtgccggtccctgagcagggtccgaatgggcgacaatttcctcaacgggtcgatccccaaggggctcttcggactccccatgctctcccaggtcgaattgcaggacaattatctcgagggcgagttccctgtgaccgacggctctgtcgccgcgagtctcggtcagattagtctctccaataacctgttatccgggtctctcccgccgagcatcggcgacttctcc

SEQ ID NO: 166 - DNA, 569 bp, Eucalyptus grandis
ctgttccagaggcaagctccagaaagttatcgtcttcaacaatcgcttcacaggacgcttgccgagttcgctagcgagctgtgattctctcgaatacgtccgaatcagcaacaacggactctccggcgaggtgccgcccgggttttggggcctccaggcggtctcgtaccttgacatgagctacaataagtttgaaggggcgatttcgcggtcgatttcggggcccatgggcctgaagtcacttctgatcgccggcaacaaattctctggtgatattccggcggagatttgccagctctcaaacctcaccgtcgttgatgtgagcaacaaccagtttggcggtggactcccgacgtgtatcaccaatttgggcaatttgcagaagctcaagatgcaaggcaatttgctcaccggcccgattccgagttcagtagggccatgggccgatttgacggagttgaacctttcgaacaaccggctcactgggagcataccggctcaattaggcgacttgccggtgctgaggtacttggacctctcagggaactcgctttccggcgagatcccaa

SEQ ID NO: 167 - DNA, 844 bp, Eucalyptus grandis
gctccgacccgatactctttcgaagaagaacattcccgagtcggctgatttgaattcgacctgcgggaaagcgcactgtccgaacagattaagtggccgaagagccggtgttgttttaggggtggttgcagtcgtagctgctatcgggttcgctgtcgttggatttctcaccttctcatggcaccagcatcgaaagcagaggaattcaagctctctagacgttttggataagcgggtccgtgccagtcgagcccttgagaatcgctcgaagagggcctctgctctcatcagtctcgagtactcgaacgggtgggatccgctggccaaaggcggtggcgggagcgccttctcccaggaggtttttgagaacttcatgttcaacttggaggatgtggagcgcgcgacccagtctttcctggagagcaatttgctggagaagagcagcttctcttctgtacacaggggaatcctcagggacgggtcaaccgtcacggtaaagcgctatgccaagatgaactgcaagtccgatgaggccgaattcctcaagggcttgaaactcctgaccaaactgaagcacgaaaacctggtcaggctcaggggattttgctgctcgaaagggcgaggcgagtgcttcctgatctacgagcttgtgccgaacgggaatttgctgcagtatcttgacacgaagcctggaagcgggaaggttctcgaatggcatacccgagttgcgatcataatcggcatcgctcaaggaatcagctacatacatgaagatgaaggagacaagcccagactagtccatcagtcgatatctgccgagaaagttctcatcgattactggaac

SEQ ID NO: 168 - DNA, 557 bp, Eucalyptus grandis
cggctgggtcggggtcacgtgcgacgggaccaactcgtccgtcgtcgagctccgcctccccgccgtcggcctcgtcgggcccgtcccggagggcaccatcggcgggctgtcccagctccaggtcctcagcctccggtccaaccggctctccggctcggtcccctcggacttctcgaacctgaccctcctgcgcagcctctacctccagggcaatagcttcgccggcggtttcccgccgggcctgactcagctgactcggctaatccggctcgacctctcctccaacaacttctcggggcaaatccccttcggggtcaacaatttgacccgcctgacgcgcctcttcctccagaacaaccaattctccggcagtctccccagcatcagcgccggcggcctcaccgacttcaacgtctccaacaaccgcctcaacggctcgatcccgccctccctcgcgaagttcgacgcgtccgccttcgccggcaacctcgccctctgcggcggtcccctccaggcctgcagcccctccttcttcccccctcctgctccgccgccga

SEQ ID NO: 169 - DNA, 425 bp, Eucalyptus grandis
gaaatattgggaggaagacaatgtacttgcactagtggaccctaaaatttctgttggatgctccgagattgagatcataaggtgcataaatgtggggctgctttgtacacaagaacttgcaaatgataggcctaccatttcaactgtcatttcaatgattaacaatgaaattgttggtcttcctcgtccgaacaaacctgcattcaccgagaggcaaacaactacagacacaggttcctccagacaaagtcagaaaaaatactctgccaacaatgtcactattaccgctcttgaaggcagataaaatgaggataccaaaaccaataagctcgaaagttcagctcagagatgcaaactatagccagctcgtgtcttggacatggagtcaataatgagtactagcgtgatcctatttgcatgtactg

SEQ ID NO: 170 - DNA, 433 bp, Eucalyptus grandis
cttcttcttcgaccctcgttctgtagcggggctagggttcttcctctctccctagatcctcacgagggtgatggaagactctgcagatgcccagtacgagaggaaggagcgtgcggctctggtcatcatcgtcgtgctcgcttccctggccctggcgtccttgctcgtggccttcagctactactgctacatccgcaacaaggtctccaagcgcttgaagaaggcccgagggtttaatgatgcggagaaaagtggttttggggatctgcaaatagcttccgagaacggacttcaggtgttcacattcaagcagctacattcagctactggtggttttagcaagtccaatgtggtcgggcatggtagcttcggattggtctatcgaggagtgctcagcgatggccggaaagtcgccattaagttcatggaccag

SEQ ID NO: 171 - DNA, 471 bp, Eucalyptus grandis
actcagtccacttctctctcctcctcctcctcctcaaacccatttccgtaatctagccatagctcccgaatcctctctcactgtcatgaacggtaacctccaggcagtcgtcgccgcggccgcgagcttcgtcggcgtctccctcttcttcgtcctcctcgcctacgcctgcagccgccgccgccgcaggctggaccgcgcccgcgaggcccgcaaccggacccgctcgatctccaacccggatgaggagctcgccgccaccgccgtcgagcagaacgcctccttcgactccaagatcaagatcaccatggatgagctccggaaggccaccaagaacttccaccccaagaagatcatcggcgacggcggcttcggcctcgtctacaaggccatcctcgccgacggcggcggcggccgcaccgtcgccatcaagaagctcgagcccgacgccttccaggggttccgcgagtt

SEQ ID NO: 172 - DNA, 317 bp, Eucalyptus grandis
tagacctcagcttcaacaatctgagtggcaaaatccctgaatcctaccgcagcctggaaaacataggatatccctatctgactggaaaccagttgactggagcagtccctgattggatcctggtgaaaggaaaaaatgttgatttatcatacaacaacttcacttctggaggctcagaatgtcaagaaagatctgtcaacttgttcgcaagctctgaggttgagaatgcaacctcatattctgccacgagtggacttgtctcatatttgcagagtccccattgtacaaaaaatcggtataagctcttcataaattgc

SEQ ID NO: 173 - DNA, 212 bp, Eucalyptus grandis
caccgtaaagcgaacccaagaaatctctcttcctctctctctctctctctcttctgggttttttttttgccagcaccaccctaatctcgtaaagctagaaggatactattggacatcatcattgcagcttctaatttacgaattcgttcccagcgggagcttgtataagcatcttcatgatgcaaatgaaaaaaacagcctaacttggaggc

SEQ ID NO: 174 - DNA, 431 bp, Eucalyptus grandis
ccgttgcaattaaagatgtggaggcaactgtggcagagaggaagtttagagctgcagtcttgagagtgggaagcattcatcacaaaaatctcataaggttggagggctattgttgcgagtctatccacaggtacttggtctacgaatatgctaaaaacggctctttggagaagtacattgaagaccctgagctgagtaagagattaacttggaagaagagaatggaagtgtgtttgagcgtggcaaagacactgtcttatttgcactcagaatgtagagagtttataagtcatgggaatttgaaatgtgaaaacattttgctggacgagaatctagatgccaaggtctctgagtttgggctctcaataattcacggtgaagcactaagccctgacacgtcagctgagagggatgtggaggattttgggaag

SEQ ID NO: 175 - DNA, 488 bp, Eucalyptus grandis
gcaaggaatggattgtcaggtcaactgcctggtgagttgagcaaacttactcgtttggagtaccttgatttatcaagcaacaaattttctggtgaaattcctgcgaatcttccacccagccttgttgtatttaatgtgtcacataatgagctgtcggggaaagtccctgaaaacttgcacagatttcccaggtcgtcatttgagcctggaaatcctttgctgaacttgggaaagcatttcccatcagcaaattccaatggccagaataacaattcggacaaacatggaagctccaaaagtaatataagagtagcaatcattgttgcctcagtcggggctgcaatgatgattattttcgttttatgggcttatcgtcgagcacagcacaaagaatttcatgggagaagtgggttcagtggccaaagttcaggaagagatgtaaagcttgaaagatttgcacgtccttctctatttaaattccactcaag

SEQ ID NO: 176 - DNA, 513 bp, Eucalyptus grandis
ttagctcaaccaaattgactgatcttaacttatcgggaaacaacttcactggttcaatccctcttgaggaaaatttaggtaattcttctgtaggttccgctcagaacttcagcctttcgattattgatctgtcaaataactcattaagaggctctctccctcgggaaatcgacagattccacaacttagtatatctggacctttctcgcaactacttggaaggcaaccttcctaatgatctgcctgatgaacttcaaggatttaatgtttctcacaataatttctcaggcactgtgcctgaaaacttgagaagatttcctgattcagcattccatccaggaaactctttgctggtttttccttattcaccaaaatctccagaaggccctccagacaggattgagcgacctcggggacatcgtttgagaactgctattaagattgcccttattgcaggtttggttggaggtgcctggatgatagctattctatgcttcattatctcgcgcagca

SEQ ID NO: 177 - DNA, 451 bp, Eucalyptus grandis
atttttccggagagattccgaagagtggtggcgttagtagtactcccagcatgaggggaactgtttgttatattgcccctgagtatggcggcggcggcgatctctcggaaaagtgcgatgtgtacagttttggagtgttgttgttggttcttattgccggacgtcgcccgcttcaggtgaccagctcgcccatgtcggaattccagcgtgccaatcttttatcttgggctcgccatctcgcccggagcagaaagcttgttgatttggtcgatcagtctattcagtctttggatcgggaacaagcacttttgtgcatcacggtcgctctactttgtttgcaaaagtcgcctatacgcaggccttccatgaaggaggtcgtggcaatgcttacaggggtctctgaaccgccgcaattgccatcggagttatctccttcaccacccacgtcgac

SEQ ID NO: 178 - DNA, 450 bp, Eucalyptus grandis
aactctatggcttctgctgcagtcaaagctctaatcttctcctatacgagtacatggccaatgggagcttaggagaacagcttcattccagtgaacaggtgtgcttgcttgactggaatgaccgttataaaattgctttaggagcagcagagggcttgtgctacctccactatgattgcaagcctcaaatcatccaccgtgacatcaaatccaacaacatcttactcgatgaattgctcgaggctcatgttggggattttggcttggcgaagttgagtgactccttctcaaagtccatgtctgctgttgcaggttcatatggctacatagccccagaatatgcatatacaatgaaagttacagaaaaatgcgacatatatagctttggggtagttctcttggagctcattaccgggaaaactcctgttcaaccccttgagcagggagggg

SEQ ID NO: 179 - DNA, 422 bp, Eucalyptus grandis
gcaaggcgggagggtgctcactccgagctgcaacgtgaggtacgaggtctcccccttttatgacgcctcagcccttccgccgcctcagcctcggcttcctgctccagcacctccgcctcccgctccgatgaccggacctacaggttcatttgtatttgctccagtacctccgcctctcgctccgatgaccggacctacgggaaaaagtaacaaatctactatgatgaccgtcaccattactgtttttgttggtgttatggtacttctctttctcacttgttgtttgcttcgaagaaaaggaatgaagacgtatgaagttgtcacaggaaaaagtgctacaaatgaacttatcaccagggagtccttgaaatttgacttggctactatacaatccgcaacaaatgatttctctcctgaaaaca

SEQ ID NO: 180 - DNA, 454 bp, Eucalyptus grandis
ccgagaatgcgtcaactgggtctgggtacacctcaaagttgttcactgatgccagatacatatctcaaagcatgaagctgggagcacttgggcttccaccttaccgaacctattctttggaggagattgaagaggccacaggcaactttgatacatctgctttcattggtgaaggttctcatggccagatgtacagaggtcagctgaagaatgggtctcttttagccatcaaatgcctgaaaattaagaaaagccagagcattcagcacttcatgcaccacatcgagttaatttcaaaacttagacatcgccatgttgtcagcgctcttggacactgcttcgagtgttactgggatgattcgagtgtgagcagaatctttcttgtgttcgaatatgtaccaaatggtacattaaggagctggatctcggggcggcgtggtaggcaatcactcac

SEQ ID NO: 181 - DNA, 501 bp, Eucalyptus grandis
ggatgatgaagggaccgtgccccatcatgtgtccacaatcgttaaagggacgccgggataccttgacccagaatatttcctgacacacaagctgaccgataaaagtgatgtctatagtcttggagttgtatttctggggctattgactggaatgcagccaatatcgcatggaaagaatattgtcagagaggtgaacatggcgcaccgggcaggcatgatgttctctattatagacagcaggatgggctcttacccttcggaatgtgtcgagaggtttgttgctctggccctcttgtgttgctacgacaacccggagaagcggccgtcaatgttggacgtggtcagggagctcgagagcatactcaaaatgatgcctgatgccgacgccatactttctgagacggcttctgattattcaggcaagtcacttccatcatcttcatcttatgcgagcatggacccgtatatttcatcaagcgtctcgggaagtgatctgataac

SEQ ID NO: 182 - DNA, 495 bp, Eucalyptus grandis
ggaatacctgcacagtttagcccaacaaagttttatccatagggatttgaagccatcgaacatactgctgggagatgacatgagagccaaagttgctgactttggtttggttaaaaatgctcctgatgggaagtattccgtggagacacgtttggctggaacttttgggtatttagctcctgagtatgcagccactggaagggtaactacaaaggtcgatgtttacgcatttggtgttgtcttgatggagatcattactggtagaaaagcattagacgacaccatgccagatgagagggcgcacttggtcacttggttccgtagagttctgattaacaaggaaaacatcccaaaagctattgaccagactcttgaccccgatgaagaaaccttagagagcataatcaaagttgctgagctggctggtcattgcactgctcgggaaccgttccagagaccggacatgggccatgcggtcaatattttgggtcccgc

SEQ ID NO: 183 - DNA, 1033 bp, Eucalyptus grandis
gtcaagaggatggagtccggtgtgatctcggagaagggcttcaatgaattcaaggctgagattgctgttcttaccaaggtcaggcacaggcatttggttgcattgctggggtattgcttagaaggaaatgagaggcttctcgtttatgagtacatgcctcaggggactctcagcagacatcttttcaactggaaagatgaaggactaaagcctcttgagtggacaaggagactcagcattgccttggatgttgccagaggggttgaatatcttcacggtttagctcatcaaacttttattcatcgtgatcttaaaccatccaatatactccttggggatgatatgcgggcaaaagtggcagattttggacttgtacgtcttgctcctgagggtggtaaaggctctattgaaacacgtcttgctggaacttttgggtatcttgcaccagaatatgccgtgactggacgggtgaccaccaaagccgatgtcttcagctttggagtgatccttatggagatgatcacgggaagaagggctctcgatgaaacccagcctgaggacagtgtccaccttgtgacatggttccggagaatgcacctcaacaaggacacattccggaaagccatcgacccggtcatcgatctcgacgaagaaacactagcaagcgtaagcacgattgctgagctcgcaggccactgctgtgggcgggaaccttaccagaggccggacatgggtcacgcggtcagcgtgctctcgtcgcttgtagagctctggaagccatccgagccagactctgaggacatgtatgggatcgacctggagatgaccttaccccaagcactcaagaagtggcaggcctatgagggaaacagtaacattgacgaatcttcttcctcatttttagcgagcaatgagagcacccagacgagtattcctacgcggccgtctgggttcgctagttcattcacttcggcagatgggagatgaaggctttcttggtattggacttatttgtcgatccgtttcgcctcgt

SEQ ID NO: 184 - DNA, 658 bp, Eucalyptus grandis
gagttatgcatggaagctctttcaagaagggaagtcattggatctggtggactcgagccttgtcaaatacaaccctgacgaggcagcaatgtctattcaactaggattgctgtgctgtcaagcaagttacggagacagaccagatatgaactcggtgcacctcatgctttctagtgattcattcacattgcccagaccaggaaaacccggaatccaagggcgaacagcacgttggacaacgacttcgtcttccgcattcaccaaaactaatccaagcagtacacaaactggaggtactaaagtttctactggtagcagcttttgccgaggagtattctagaaattcaatctccatttcctccatagatgaaggcagatgaccttaaagatgtaagattcctttattatttatagcaggtctaatattcttttacaaattcttttgtcgatatgcttatagaaaaagaaaataaaatgatggggtgctctaggatccataggatactcatgtaactttttcgggagggatcaggtacgtgccctatggatagtcttgaagagctaatctagaatgaatcctgtttctactaccagttcacttctaactgattgtcaacatgcaattacttctgccaacattgagaaaaaaaaaaaaaaa

SEQ ID NO: 185 - DNA, 517 bp, Eucalyptus grandis
gttgcatcgtgatataaagtccagcaatatcatgctcgattccgattttaatgctaaattaggggacttcggtttggctagactagttgaccatgccaaaggattacaaacaacaatattggccggaaccatgggctatatggctcctgattgtgtttacaccggcaaggcgagtaaggaatcagatgtctatagctttggaattgtcctattagaaatagcttgtggaagaaaagccatcgagccaagggccgaggaaagccaagtcctattggtggattgggttcgggagctatatgggattgggagggtactcgatgcagcagagtctaaactcggtaccaatttcgatgagaagcaactagagtgcttgatggttgtagggctgtggtgctctcatccagaccacaccgcccgtccttccataagagaagcattaaatgttctcgactttaatgctccgctacccaatctctcatcgaaattgttggtccctacatatatagcacctctatcc

SEQ ID NO: 186 - DNA, 610 bp, Eucalyptus grandis
tttaggcaataagtgggcgaaagccttaaagaaaagcaaaggtgtcaaggtttccatgtttgagaagtcagtttccaagatgaaactaagtgacctgatgaaggctacaaacaatttcagcaaacactgtataattggattaggaaggacagggacgacatataaggccgtgctcgaggataatactctactcatggtcaagaggttacaggattctcaacactccgagaaagaagtgatgtctgagatggctacactaggaagggttaagcaccgcaacttggttccacttttgggtttttgcatggccaaaaaggaaaggcttctggtctacaagtacatgcccaatggtatactccatgatcaactacattctctgtctctggatgatcccagcaaagctttggagtggactttgaggctcaaaattgggattggagcagcacgaggactggcatggcttcaccataactgcactcctcgtattatccaccgcaacataagctccaagtgcatccttcttgatgcggactttgagcctcagatatctgattttggtctggctaggctcatgaacccaatcgacacgcatttgagtacttttgtgaac

SEQ ID NO: 187 - DNA, 448 bp, Eucalyptus grandis
cccacgacgagctcggacgtgtttgcgttcggtgcattgctactcgaggtcgtctgtggcagaagacctatcgagccgaaagccttgcctgaagagctcattctggtggactgggtgtgggagaagtggaggacaggggctatactggatgtggtggattcgagattgaaaggtgaatttgacgagatcgaggccgttgtagtgttgaagctgggattgatgtgttcgaacaatgccccggagtcgcggcctacagtgaggcaggtggtgagatacttagaagggcaggtggcgttgccggagacagtggccgcaccagatgcggatgatgagaagaagggcaaaatctgcagcgctagcgatgggaattttgatgattttgtccattcctatcggtatccgacgtcttcatttatggagaaggtcagcacatgttcatccgatgatc

SEQ ID NO: 188 - DNA, 499 bp, Eucalyptus grandis
gtttcggaggagtctatgaaggccacctcgctgatacaaattcccacgtcgccatcaagaagatcactccagagtccaaacaaggcgtcaaggagtatgccaccgaagtgaagacaattagacatctcaggcacaaaaatttggtggagctcatcggttggagtcatgagagaaacaagttcctccttgtgtatgagtacatgtctaacggtagcttagactctcatttgttcaaagataaaatgccgctgccatgggaaaagaggtacaatattgctcaaggcatcgccttagggctgaaatacttgcacgaggatttgaaacaatgtgtcgtgcacagggatataaaatctagcaatatcctacttgatgcacaatttgaggctaaattaggcgattttggcttggctcggatagtcgaccatgccaaagggtcacaaacaaccctattggctgggaccatgggatatttggctcctgaatgtatctatacaggtaa

SEQ ID NO: 189 - DNA, 567 bp, Eucalyptus grandis
agacattgatttaccgttatatgatttttcgaccattgccgttgctactggacatttctcacagaccaacatgattggagcgggtggctttggttcagtctacaagggaaatctctccatgggtcaagaaatagcggtgaagaggctgtcgaaaggttcaagacaaggccttgaagaatttatgaatgaagtactcctaattgccaaacttcagcataggaatcttgtcggacttcttggctgttgcattgagggagaagaaagaatgttaatatatgagtatatgccaaataaaagcttgaattatttcattttcgatgatgacagaagcttcttgttagcatggaagagtcgctttgacatagttttaggaattgcgagaggtcttctctatcttcatcaagattcaaaactacaagtcattcacagagatctcaaaacaagcaatatactgttagatgcagacctcaaacctaaaatctcagactttggccttgcaagaatctttggaggcaacgaaagagaagcaagaacaaaaagaatcgttggtacctatggctatatgtc

SEQ ID NO: 190 - DNA, 503 bp, Eucalyptus grandis
cccaggccgagacccttcggagaattcaatatctcctggacaatccacctgttttaagcggctggaaggacggcacagatttctgcaatactgagcccaattcatctctcaccatcgtgtgctatgaagaaagtgtgacacagcttattataataggtgagaatggagctcctgcattgcctcaaaatttttccatggattccttcgtaacgacgctggtaaagcttcctaatttgaaggtcctcacactagtttctctgggtttgtgggggccattgtctggtaaaattgcacggctttcatcgcttgagatattcaatgtgagctctaatttcttgtatggtgcacttccccatgagctttcatttttgaaaagcctgcaaacgctcattcttgacaagaacatgttctccggtccactaccagattggactggtaagctcctgaatttgaccgtgctaagtctgagacaaaattcatttaacgggtctctgcctgatgct

SEQ ID NO: 191 - DNA, 601 bp, Eucalyptus grandis
cagagatgtgccgctctttgatctgagtaccgtagcttcggcaacaaacaatttctcggtcctcaataagctcggtcgaggcggttttggatcagtatacaagggcgttatggacaatggaatggaaatagcggtcaaaagactatcgaaacattcaggacaaggagttaaagaatttaaaaacgaagtccggttaattgcgaagctccagcaccggaacctggtgagaatactaggctgctgtgtcgaagaagacgagaaaatgctaatttacgagtatttacctaacaagagcttggataccttccttttcgacaaaacaaaaagattgttgccggattggaaaaaacggttcgaaatcgcatccggggtggcacgaggactcttgtacttgcaccaagattcgaggctcaggatcattcaccgagacctaaaggccagcaatgtcctactcgatgctgtgatgaatccgaagatagccgatttcggtatggctaggatatgcggtggggatcaaatgcaaggaaacacaaatcgagtagtcggaacatacgggtacatgtcaccagagtacgcaatggaaggtatattttcaataaaa

SEQ ID NO: 192 - DNA, 771 bp, Eucalyptus grandis
ttaagacagatcaaagctgctaccgagaactttgatgttggaaacaaaattggcgagggtggatttggggcagtctataagggtcaactatcagatggaactatcattgcggtgaagcagctctcatcaaaatctaagcaaggaaatcgtgagttcgtaaatgaaataggcttgatatccggcttacagcacccaaacctggtaaaattatatggatgctgtattgaagggaatcagttgtcgcttatttatgagtacatggaaaacaactgcctttctcgtgctcttttcgggaaggatgctaccagaaagttaaaactggattggcctgctagatggaaaatttgccttggcatagccagaggtttggcctatctccatggagaatcaatgctgaggattgtgcacagagatatcaagactagcaatgtgctgttggataaggatctcaaccctaagatctctgatttcggtttggcgaagctcaatgaggatgggaaaacccacatcagcacaagagttgctggaaccattggctatatggctccggagtatgcaatgcgcggttatctaacagacaaggcagatgtgtacagctttggagtagttgcactggaaattgttagtggcaagagcaacacaaactacaggccaacggaagaatttgtctatcttcttgactgggtaaaacctcctcttgagctactttttcttcctttatttgcgatcgtgcatatatgcatatgctttctattctctagtgtcatgtgc

SEQ ID NO: 193 - DNA, 753 bp, Eucalyptus grandis
cttgatctctccaacaaccgtttgactggccctatcccacagtctctctcgcttgaagcatacaatggaagcttttctggaaatcctggcctatgcaccgccgcaaggatcaaatcattcaagcaatgttcgtctcatccaggctcatcgaagatcatccgaacggtcgtaatttgcttccttgtagcttcagtgctactactgacctccctggcatgctttcttttcatcaagaacagagaaaagaatggagacagcaagtcaagagaagagtcctgggaagtgaagtcgttccacacgttaaccttcacagaggacgagattctcgaatccataaagcacgagaacatcattgggaaagggggttcgggcaacgtgtacaaggcgaaactccctagtggccgagaactcgctgtgaagcacatcccgacggcggattctagtacccatggaaggagcctcagtactagcccaatgctaggtaagggctgcaaaagatcccgagaattcgaatccgaggtccgtgcattgagctcgattaggcacgtcaacgtggtgaagctgtactgcagtatcacgagtgaagactcgagcctgcttgtttacgagtatctccccaatggcagcctgtgggacaggctccactcatccgggaagttggagctggactggaagacgcggtactggatcgcggtcggggcggccaagggattagagtatctgcatcacgggtgcgagaggcccatgatccac

SEQ ID NO: 194 - DNA, 449 bp, Eucalyptus grandis
gcggagggcctggcctatcttcatgaagagtcaaacttaagaatcatacatagagacattaaattaaccaatgttttgctggacaaagacttcacgcccaagattgctgattttggactagctaggttatttccagaagatgcgactcatatcagcactggtgtcgctggtacattgggctacatggctccagagtatgttgttcgcggcaaattgactgaaaaggtagatgtctacagctatggcgttctcatgatggaagtactctctggaaagaagaattattccttctccgagagttcctgttccatcttacaaacggtgtggaatctgtttggatcgggtaggctgtgtgaagccatagatccaattctagaggggcaatttcaagagcaggaggtgtctaggttacttcaaattggtctactgtgcgtgcaagcctctgcaga

SEQ ID NO: 195 - DNA, 413 bp, Eucalyptus grandis
gaataacgggagacttgttcacggaaacgtcaagtcatcaaacatccttatcaacccacagcagtatggctgtgtttctgatcttggcctggctgctgtaatgagttccctagctccacccatttcccgagctgctggttatcgagcgccagaagtgacagacactcgtaaagcaggacagccatcggatgtctacagctttggagtcgtcttgcttgaactgttaactggaaaatctcctgttcacgctacaggctatggtgaaatggtgcacttggtgaggtgggttcattccgtggtgcgagaagagtggacagctgaagtatttgatgtcgagctgatgaggtatccaaatattgaggaggaattggtggagatgttgcagatagcaatggcctgcgtcgtgaggatgc

SEQ ID NO: 196 - DNA, 399 bp, Eucalyptus grandis
aacctgtcaagaacagaaaggcaagtacagaaccggtggagtacctgttggtatatccattggcggtcaacggaaatgtgcgttcccgcttgagggagtgctctgcattgcaaccccctctcgattggcctacccggatgcacattgccttaggagtggcgagagggctctcgtatcttcatgaggattgcagtcttctgataattcaccgcgacataaagccttcgaacattttcttggatgagaacttcgaacctctcattgcggaattcggcgttgcaaaattggtgaaccttgaagattggaagcagcagatccaggagtcgaaaagcgccagggcaccgcaccagatggctgctctggatagatcagaaaagttatacgggacccaaagggcag

SEQ ID NO: 197 - DNA, 483 bp, Eucalyptus grandis
gctaggttctcggcgtcgagatctttggcagatagtgctgcttgggtaagtcatatgtcagaagttgccagtccatccccgagcaatgatatgccagagggaaataatgcacctcagacaaccgaagagaacaacaccgagaccgagagaggtggagaagaaggcggccatggattaaccatggagtctgaaaagtttagtggaccaaagaacttctcctatgaagaattgatgacagcgattgcagatcgcaagattctgggaaaaggaggtttcggcgcggtgtacgaagggcgcataggaaaagctcgcacacaggtcgccgtgaaggttataaactatgattcgcaccaagggatgaatgagtataaatctgaggtgatcacgttgagccagcttaagcacaaaaacttggtgccacttataggctattgcacgaggcggataattggcctgggttacgaattcatgagtgaaggtagc

SEQ ID NO: 198 - DNA, 637 bp, Eucalyptus grandis
ggaactactctttactctgatgccatcttgaatggcctcgagatattcaagatcaacaatcctgacgggaatctcgcagggctgaacacggatccggatccggtcccgaataaactgccaggacctccaccggcaagcaaggcaccgtcgagcctcagcaaagcagtaaaaattgccatcgttgcgggtggaacttcgggcttcaccatactctctctcctggctttcttcctttaccggcgacgaaacagagcgaaggattcgacctcgagcgacggcacctcacggtggggcccgttctcctacgcgacgaccaagtcaacgaagacccagggttcgtccctgccgtcggatcggtgccgccacttctcgctaacggagataagagcggccacgaacaacttcgacgaggtgtttattatcggcgtgggcgggttcggcaacgtgtataagggctatgtcgatgggggcgccacccaagtggcgatcaagcggctgaacccagggtcgcagcagggccaccacgagttcatgaccgagatcgagatgctctcgcacctccggcacctccacctggtctccctgatcgggttctgcaacgacgcgggagagatgatcctggtgtacgactacatgg

SEQ ID NO: 199 - DNA, 432 bp, Eucalyptus grandis
gcaagatcacacgcgagagcaggccatcaaggtgttgaggatcgcggttctgtgcacggagaggcttccttcactgagacccaccatgagacgcgtggttcagatgctggaggacgccgaaccatgcggaccggtcgacattgtcatcgagaaagccggcaagtcaggtgtggagggcgggaaaagctgagcaggatgtgcaactaaatagggggaatggggtattagccgatgccgatgcctgatgtcgtcgacggagcaagacatcgaaggcccgggatgaagggcgagcgctccgcatcactagccctccgggagcacccgatgctccggaacccaaacattttgggatggaatgttaaggaccggacaaacgaagagaaactctggtgcaggagcatttttagattgtgtagtatgggaaacttaatg

SEQ ID NO: 200 - DNA, 508 bp, Eucalyptus grandis
gtttgacaaaattgactgaggttggaggtgcgtctctcacgacacgacttgtagggacatttggatacatgccacccgaatatgcccagtgtggcgatgtctctcctaaagtcgatgtgtacgctttcggtgtggtcctttatgaacttatttctgccaaggaggctatactcaaggcaaacggttctattgctgaatcaaagggcctcgttgctttgtttgaagaggttcttaaccaacccgatcccagagagaaccttcgcaagcttgttgaccctaggcttggagatgattatccgcttgattctgtctggaaggtggccatgctagcgaaagcttgcacacaagagaatcctcaaccgcgccccagcatgagatctattgcggtggccctgatgacgctttcatcttcgacggaggattgggatgtggctcctacgagaaccacgctctggtgaatctaatgtctggaaggtagaaatccccccttttggccggaatcaggcaa

SEQ ID NO: 201 - DNA, 951 bp, Eucalyptus grandis
cacgatcattcaccgtgatgtgaaaactaccaacattcttttggatgagaagtgggtggcaaaggtctccgattttggtttgtcaaagaccggtccaacgttggatcacacgcatgtcagtactgttgtgaagggtagctttggatatctggatcctgaatacttcagacgccagcaattaaccgacaaatctgatgtgtactccttcggagttgtgctgttcgagatcctctgtgcacgccctgcattgaaccccacactgccgaaagagcaagtcagtctagcagaatgggctgctcattgccacaagaaaggcattctcgagcacattatggatcctcatctaaaggggaaaatctcgccagagtgcttcaaaaagtttgccgagaccgcaatgaagtgcgtcaacgatcagggcatcgagaggccatcaatgggcgacgtcctgtggaacctcgagtttgccctgcagctgcaagagagcgcggaggagagcggcaagggcttcgggggagtgggcatggacgacggggctttcgatgctgcggcctgcaaagggaagaaggatcccgacgtatcccctggcttcgacagcaacgtgtccgactcaaggagcagcgggatgagcatgagcattggcggccggagcctcgccagtgaagactcggatgggctgaccccgagcgccgtgttctctcagatcatgaaccccaaagggcggtgaaaaaactaggacactgcctcccatccgcctccgcaaaatctctaaggagacacttgccactgcaaaaatgtcgagcattcacgacacgttttgggtttacctcgatcttttcttattcatttaacttgctgtcaaaattccatctttttcccatcttttttccggcttctgatataatcctgtattctccaaggcagttgtaatttgtttagtaaatttatatatgg

SEQ ID NO: 202 - DNA, 661 bp, Eucalyptus grandis
gatctgggatatgtggcaccggagtatgcacgaaccctcatggccaccccaaagggagatgtgtacagctttggagtcgtgcttcttgaactggtaactggtgagaggcccactcaagttcttaaagcacctgaaacttttaagggtaatctggtggagtggatctcggagctctcaagcagctcgaaactccacgatgcgatagacagacatttggttggaaagggaattgacgatgaagtctttaaagtccttaaggtggcatgcagttgtgtgttgccagctccgaaggagaggcccactatgttcgaagtctatcagttcctaagggccattggggatcggtaccatttctcgaccgaaaatgaacttatgatgcccatagacagcggcgactcggattgcttggaagaacttattgttgctcgagaagcaaccacagaatagcacagtcgagctcctttgggtgagtgacagtcgactctacatgcctcctatgctagatgtaactagtatgtgtggtaaatgtttaaatagatattaccccgtagctttgtatgtctaggcacactgcttcttgtcatgctgttcgaagaggtggatatcctctccatattactatagatagcaatacctattttctccaaaaaaaaaaaaaaaa

SEQ ID NO: 203 - DNA, 587 bp, Eucalyptus grandis
atttcaaataaccaaaagttaaatgagaaactggagaagcaattcgtagcagaagtggagatacttgggaacattaagcatcggcacattgtcaaattgttgtgctgtatttcttgcgagaagtcgaaactcctagtgtacgagtacatggaaaatagcagcttggaccgttggcttcacaagaagaaacgatcatcgcccatctcgggtgtctccaacaatatgatcttggattggcccaaaaggttgcagattgcgctcggagcagctaaaggactttgctatatgcataatgattgttcatcacccatcatccaccgagacgtgaaatcgagcaacattctcttagactcagagttcaacgcaaagattgctgacttcggccttgcaaggatgttggccgagcctggggaagctgttagcatgacagccgttgctggttctttcggctatttggcaccagagtatgctcatacaacaagagtcaatgagaagatcgatgtctatagctttggggtggttctcttggaactaaccactgggagagaggctaatgacgaggacgaagacatgtgcctcgctgattg

SEQ ID NO: 204 - DNA, 433 bp, Eucalyptus grandis
gcaccaggtcggcattgctgctggtggcagcgttctgttgttagcactcaccgccttcctcatgtggaagaggaagacttcgctgaatccacacataagaaacaccgaaccgcaaggagctcgtgagagaagccaagattttctgttaaatgaagtagtcatctcgagtaagagagaatattcgagggaaaacaagccggaggagctagagttaccattgttcgctttcaacgcgattgctttggcgaccaagaacttcagcgacgaaaacaagcttgggcaaggcggttttggctgtgtttacgagtgtaggattgaagaaggcccagtagtggcggtcaaaaggctctcgaagaattccgggcagggaatggaagaattcaagaacgaggttcaattgattgctcggcttcaacaccgaaatctcgtgcga

SEQ ID NO: 205 - DNA, 496 bp, Eucalyptus grandis
caaaccctcccggcggggagctctggcggctacctcgggctcaccaacgccgccaccgacggcctccccagcaaccacctcctggccatcgagttcgataccttcaatcagtcctatgacccggacgcgaaccacgtcggcctcgacatcaactcggtccactccaaccagaccgtctcgctggcgaacctaggcttccaactcgctccgaacggcaccaaattcttccatgtctggatcgaatacgacggcggccagaagatcttggaggtctacatgaccgacgaggaccagtccaccccgacgaagcccaagccggggtctccaatcatgacggcgagcctggacacgagcaaggtggtgagccagaactcctacttcgggttcgctgcggcgaccggggacaacgtggagctcaactgcgtgctgggttggaacctaacggtggaggagctgccgaagggcacgccgcgggggttggtgatcgggctggccg

SEQ ID NO: 206 - DNA, 355 bp, Eucalyptus grandis
gtttggcgacggcgtggacatcgtgaggtgggtgaagaccgcgtcggaccccctcccgcagccgccgtcggacgcggccttggtgctggccgtgatcgaccgcaggctgggcgggtaccccatcgcgagcgtgatccacctcttcaagatcgcgtgccggtgcgtcgaggaggagagttccgagaggcccaccatgagagaagtcgtccacatgctgacaaacccgcctctgtccgccaccaccttcgccgtcggcgccaccccggacctcatcaaactgtaggggctctcctctcttttctcagtaaaataaaagcttatagtgctttgcaaatgatcgtggccagaagaggct

SEQ ID NO: 207 - DNA, 366 bp, Eucalyptus grandis
caaaattcggggaagtttttgaattgggagcaacggtttaatattgcccttgggactgcaaggggaatcacatatcttcatgaggaatgtcgagactgcattgttcattgcgacataaaacctgagaatattcttttagatgaaaatcacaatgctaaagtgtcggatttcggcctcgcaaagcttataaacgcgaaggatcaccggtaccgcaccttgacgagcgtgagaggcacaagagggtatttggcacctgagtggcttgcaaatctcccgataacttccaagtcagatgtctacagttatgggatggtcttgttggaaatagtgagtgggaggaggaatttttatgtttccatggaacca

SEQ ID NO: 208 - DNA, 366 bp, Eucalyptus grandis
tcttcacaacaggcccaaaggaatggccttgaaccttgattgggaaactagaaagaagatagccatagattcggctcgaggcctagcgttcttgcaccatagctgcattcctcacattatacaccgagatattaaatcaagcaatgtccttctggatgaaaactttgtagctcgggtatctgattttggcatggctagattggtgagtgccctagacactcacctcagcgtgagcaccctcgcagggacacccggttatgtccccccagagtactatcagagcttcagatgcacaacaaaaggcgacgtgtatagttacggagtgatcctgctcgaacttctctcagggaagaggccaatagattg

SEQ ID NO: 209 - DNA, 343 bp, Eucalyptus grandis
atttagagaaatggcagtcgcaactgacaacttcaatagatcgactcaagttgggcaaggaggttatgggaaagtttataaaggaaatttatacgacaacacagtcgtagccgtaaaacgtgcagaagaaggatcattacagggacaaaaagaatttttgacggagataaaaatgttatcaaggttacatcatcggaaccttgtgtcattggtaggatattgcgatgaagaaggtgaacagatgttagtatatgagtttatgcccaatggaactctgcgggattggctttctggtaaaactaaggagtaccttaacttcagtatgaagctgcgtattgcattg

SEQ ID NO: 210 - DNA, 1000 bp, Eucalyptus grandis
cttcaacctgccgcaagcaactataatcgagcttaacgacaatctcttctccggcgagctcccggcgcagatgtccggcgagaacttggtcatcctgtcgctctcgaacaaccggatttccggtgagatccctccggcgattggcaacttcagcggcctgcgtactctgttactggacgcgaacaggttctccggcaagattcccagcgagcttttctcgccgaggttcctactgagggtgaacatcagcgggaacagcatcagcggcaggattcctggttcggtcactgggtgcacttctctggcagcccttgatttgagcaggaacaatctcgctggcgagattccgaacggcttgtctagcctgaaagtgttggccgtcctcaatctgtcgagcaacagattgaccggtccagttccaaaggaaattggcatcatgaccagcctcaatacgctcgatttgtccttcaacgatctctccggcgaagtcccccacgaaggccagttcctcgtcttcaagaactcctccttcgccggaaaccagaaactctgctcgccaggccgcttctcttgcccttcgcggtcaagtgcctcgcgcacttcctcgagggttgtgatcacggcaatctcactcgtgaccgcggcgctgctcatcaccgtcacggtctaccaggtcctgaagaggaggcggcagggctcgagagcctggaagctcactgccttccagaagctcggcttcaaggccgaggacgtgctcaagtgcctggaggaggagaatatcatcggcaaaggtggcgcggggatcgtctaccgcgggtcgatgcccaacgggacggacgtcgccatcaagcagctggcgggacggggcggcaacgggctcagcgaccacggcttctccgcggagattcagaccctcggtcggatccggcaccggaacatcgtgaggctcctcggatacctctccaacaaggacaccaacctgttgctgtacgagtacatg

SEQ ID NO: 211 - DNA, 510 bp, Eucalyptus grandis
ggtgtacaaggctgaaatgccaggcggcgagatcttagcggtgaagaagctctgggggaagcagaaggagcacttgaggaggaggagaggggtcttggctgaggtcgaagtgttggggaatgtgaggcacaggaacattgtgagactgctggggtgctgcagcaacagagagtgcgcgatgctgctttatgagtacatgcctaatggcaatttagatgatctgttgcatgggaagaacaaggatcagaatttgggggctgactgggtgattcggtacaagattgcgctcggcgtggctcaggggatatgctatctgcaccacgactgcgatcccctgatcgtgcaccgtgacctcaagcccagcaacatattgttggatgccgagatggaggcccgagtggctgattttggggtggcaaagttgatccagagcgacgagtccatgtccgtgatcgcagggtcctatggctacattgccccagaatacgcatacacgcttcaagtcgacga

SEQ ID NO: 212 - DNA, 408 bp, Eucalyptus grandis
tttcaatagtctgatggttttagctcttggaaattgtgctctcaggggtcaaatccctgtgtggctattgagttgcccaaagttacaagttcttgatttgtcatggaatcatttcgatggaagcatccctttttggatggggaagatggagaacttgttttatttggatctgtcgaacaactctctttctggggagatccccaagagtttaacagagttgaagtgccttgtctctccaaactctgtctcgccaaatctcactgcttctgccggaatccctctatatgtcaagagaaataagagtgcaaatggcttaccatacaaccaggtctcgagctttcctccctcaatgtatctgagcaacaacagactgaatgggactatatggcctgaaattggtcagttgaa

SEQ ID NO: 213 - DNA, 475 bp, Eucalyptus grandis
tcgaagagaaaagatggtagtaatgtactgaaagtgaagggaactaatggcacaagtcaaaatccaaaggactttggaagtggtgtacaagaaccagagaagaacaagctagtattctttgaagggtgttcttacaactttgatcttgaggacttattgagggcttcagccgaagttcttggtaaggggagttatggaacggcttataaagctattctggaggatgggacgaccctggtggtgaaacggctgagggaagttgcggctggcaaaaaggagtttgaacagcagatggagcttgttgggaaggtgggacgacatgccaatatcgtgccactgcgtgcatattactattcgaaggatgagaagctcttggtttatgattacatgccttatgggagcttgtttgtacatttgcatggagataaaggttctggaaggacgccattagattggaattctagaatgaagatct

SEQ ID NO: 214 - DNA, 712 bp, Eucalyptus grandis
ttgaaaattctgaatctaagcggaaacaagctaaatggtttagttcctgaggctcttaaaaggagggttatagacaagaaattggacttgagttttaacgacaatcccgatcttcactggcaattcgagaaacgtaacttgaccatcttggtcccagttgttgcatcggtttcaggtgtaatcctagtaatttgtttggtcacaatttggttgatcagaaggaaacggataagaggaatggtgagattaagatctttcaattatggtgagatcacaaggatcactggaaactttggaacagagattggtgtaggaggatttgggaaagtatatcttggcactctagagaatggaaccaaagttgcggtgaagatgctctcagaaaaatcatggcaaggggacagggaatttcaagctgaggagaaacaattaatgatcgttcaccatggaaacttggtttctctacatggatattgtaatcactctaaaaacaaggcattagtttatgaatacatggctaatggaaacttgcaacagcacttacacggggacaagccagtcttaacttggaaacagagacttcgcatcattgtagatgtagcaaaaggtttggagtatctccataatggatgtgacccacccattatccatagagacttaaaagcgacaaacatcctactgaatgaaaaaatgcaagcgaaaatatccgact

SEQ ID NO: 215 - DNA, 522 bp, Eucalyptus grandis
ctgtggctgttaaagttctgcgatcagatgcttgtgagaggaaagaggaattcctgagagaggttgaggttcttagccaacttcggcatcctcatctggttctgctactcggagcctgcccagagagtcgtggcctggtttatgagtacatggaaaatggaagcttggaggagtacatctaccagcagaatggcaagccatctcttccatggtttgttcggttccggataacttttgaagttgcctgtggacttgcgttcctgcacaactcgaaacctgctcccatcgtacatagggatttaaaacctggaaatatccttttgggcagaaattacgtgagcaagatcggggatgttggattgtccaaacttatttctgatgtagttcctgataacgttacggaatatagggactctgtgttggcaggtacaatatactacatggatccagaataccaaagaacaggaactcttagacccaaatcagatttgtatgcttttggaattattattcttcaattgt

SEQ ID NO: 216 - DNA, 374 bp, Eucalyptus grandis
ttcttctcctcctgctccggtgaacggacccaaaggcaaaagcaataaatcgaccacgataatcattgccgcggccattccggttggcattgctgtcatacttctctttgtcgcttgcttttggcatcggagtaaaacaacaaagacgtatgaagttgtccaagcagaaggggggacaagtgaacttacaactactgagtccttgctgtaccatttagctactatacaagctgccacaaacaatttctctcatcaaaacaagttgggagaggggggatttggtgcagttttccggggtaggcttccgaatggacaagaaatagctgtgaagaagctatctaaaagctcaggacaaggtgttggagaattcaaga

SEQ ID NO: 217 - DNA, 666 bp, Eucalyptus grandis
ggctaaggtttctgatttcgggctctctcttatgggccccgaagacgatgagtcccacctctcgctccacgctgcagggacgcttggctacgtggatcctgagtactaccggctccaaattctcacgtccaagagcgacgtgtacagctttggagtcgtcctgctcgagctactatcggggtacagggctattcaaaacaacgagaacggcgtgccaaggaatgtggtggactttgtgatcccctacatattgcaagacgagattcacaggatcctagaccggaaggtcttgccccctaaccctatcgaaatagaagccgtgaggtacgtaggatacttagctgcagactgcgtgagcctggaaggcaaagatcgcccgacgatcacggaaattgtatatagcttagaaagagctctggctacatgcttggcccgtcccaagctctctaggtcttcaacagaatcctcgaccgcgtagccatcctcattcgttgtgaacagcacggcgactcaccattcccaagccaaatgtgcagagaacaccattctttcttaattctttccatgtctacctgtctctttttgtacggttacattctttccttccttcgattcagaggagggaataagggcaatagatgtttctccaacatgccatttaaaaaa

SEQ ID NO: 218 - DNA, 1021 bp, Eucalyptus grandis
tacaaagggaagctatcgaacgagattttcgtcgctgtgaagatgctggacaattcattcgggaatggagaagagttcatcaacgaagtgagcacgatgggaaggattcaccacgtcaacgtggtccggatggttggtttctgtgccgacggtttccgaagagccttggtgtacgagttcctgccgaacgagtctctggagaagttcatatttcagggcgaggacgctctcgaccctttccttagttgggagaggctccacgatatcgctctcggagtggccaaaggcatagagtatcttcaccaggggtgtgatcataagatcctccatttcgacattaagccgcacaacatcttgctagataacaacttcaatcctaagattgcggattttggtctggcaaagctatgttccaaggaacaaagtgcggtgtccatgactgcagccagaggtaccatgggttacattgccccagaagtcttctccaggaactttggaagcgtgtcgtctaagtcggacgtgtacagcttcggaatgctgctgctcgaaatggttggggggagaaaaaacgttgatgtgaacgcgaagaacatgagccagatgtacttcccgcagtgggtctataaccatctaaataaaggtgaagagcttgaaatacgaatccgagaggatggcgaccacaacatagccaagaaactggcaattgtggggctctggtgcattcactggtaccctgccgatcggccccctgtgaaagcggtggttcagatgcttgagggagatgagtgccctgtcatgccaaaaaatccttttgtttcctccagttcaggggatgctgcaatcatgcgcggaaggctctggaacacagatctagaagttatcgcggaataagttcgagtgcccttttgcagtatgtcatctctctgtgactgaagccgtacgttatgtgatacaagaatctatgtatttagtggaaaccattgatgcgctcccaccacttacctatagtattagatccaat

SEQ ID NO: 219 - DNA, 484 bp, Eucalyptus grandis
gcgcatccttaggctcggccgcaataagctccgcggcgacttctacaacagcttcatcaactgctctcttttggaagagctcgacatgagcttcttgtacctccacggaactctacctgatttttctcctatgcaatctctccggatactcgacctctcgtccaatctcttcacaggcaagttccccatgtcagtctttaaccttaccaacctcgagtcgctcaacttcaacgagaacgaccgcttcgaaccctggagacttcccgagaccatctcgcagctgagcaaactcaagtccttgatcttgatgacgtgcatggccgagggacggatcccgccatccataggaaacatgacctcgttggttgatcttgaattgggtgggaattacctggtggggccaatccccaaagagctcggcctgctaaagaacttgaagcaactagagctgtactacaaccagctcaatggtagcataccagag

SEQ ID NO: 220 - DNA, 361 bp, Eucalyptus grandis
cgatgattcattcttgtccaacgactaggatctatacgggcgtgacggtttacaccttcggtagcaatgggagcatgatctacctcgacctgtcctacaattttctgtcagggacaatcccggaaaattacggctccatgggcttcttgcaagttctcaacttgggacacaacaattttacaggacaaattcccgacagtttcggaggtttgaagaatataggagttctcgatctttcacacaatcatctcacagggcctgttcctggttcattgggttctctcaattttctcaatgatcttgacgtgtccaacaataacctaagtggccttatcccttccggaggtcagctcacgacatt

SEQ ID NO: 221 - DNA, 396 bp, Eucalyptus grandis
acgctcaagatgctgaacatctcgtacaacccgttcgcccccggccggatcccgccggagctcgggaacttgacgaacctcgaggtgctctggctcagcgagtgcggcctgaccgggaagatcccggagtcgctcgggaggctcaagaggctcaccgatttggacctcgccttcaactacttggagggccccataccgagttcgctcaccgagttggagagcgtcgtccagattgagctctacaataactccctgaccggggagctgccggcggggctgtcgaagctgacggcattgcggctgctcgacgcatccatgaaccgcctcaccggcacgattccggacgagctgactcggttgcctctcgagtcgctcaatctctacgagaaccagttc

SEQ ID NO: 222 - DNA, 475 bp, Eucalyptus grandis
tcataatctgcctcgttgtagtcgtggttctcctatcactgtcccttgcttgctatgtccgtgtatataagagggaaaaggatcaagaaaggtcgctaaaggaagaatcttgggatgtgaagtcattccaagtgctgacctttactgaggatgagatacttgatgccatcaaggaagagaatgtcataggaaagggcgcttcggggaacgtctacagagttgtgctcaacaacggcagagaactttccgtcaagcacatttggaatacggactctgcttcctctatctcttctctcccgccagatccgaccagctccagaccctgctcgacctacccggcgccctccagtccgccagcccggacgtgttctcttcgtggacgccgaccacgcccgcctgcaacttcaccggcgtcgcctgcgacgccgccggctccgtcgtctccatcgacctctccagccagcagctgaccggc

SEQ ID NO: 223 - DNA, 366 bp, Eucalyptus grandis
agctgcccatctccacagaggcatctttggagcggactcacagcggcagtgatcccgactctactggttcgcgtctgcgattggggcagtcgaggtccttatctttttctccggctggtggattcttttcagaaagcatgaagtgcagagcacattggaagacggataccgtgcaataacgagccagttcaggaggttcagctatgaggaactcaagagcgcgacccagaacttcaagggagagatagggagaggagcgtcaggatcagtatacaagggcgttttaccggacgaaagggtcgtggccgtgaagagactcggagatttgcaccatgaggagatcttctgggctgaagtcagtacaat

SEQ ID NO: 224 - DNA, 452 bp, Eucalyptus grandis
ggacagatatcaggccccatccctgaggatataggaaactgcagtgagttgcggaatctatatctgtatcagaattcaatctctggctcaattccaaggcaaattggaaatctcaagaagctgcagaacctacttctatggcagaacagcttggtgggtacgattcctgatgagcttggaagctgcactgagctcgcagttgtggacttctcggtgaatctcttgaccggcagcattccaaggagttttgggaatctcttgaaacttcaggagcttcagctgagtgttaatcagctatcgggtaccatacctcctgaaatcacgaactgcaccgctctgactcatttggaagtggacaacaacggaattaccggtgaaattcctagtctaattgggaatttaaagagcttgacccttttcttcgcctggcagaataatctgaccggcagtat

SEQ ID NO: 225 - DNA, 550 bp, Eucalyptus grandis
gcgaaacgagcgcgccttttggtgcgaaatgagcaccaccggcggtggcgaccgtggccctccgccggcgatgacggcggtggcggtggcggtgaagggcgacttaagcggcttcgaaggaggaagaggaagccgccgcgccgtccgttgggccgtcgagaatctcatgccaggagccgatcggctcgtcttggtccacgtgatgcccagagtcacttcaatccccactccaagcggagatcgtataccggtggcggaattggacggcagtgtggtggcgatgtacgtggaggaaacgaaagtgaagtatgagcaggtgtttgttccgtttaagaaactgtgcaaaccttggaaggtggaaactttggtgctagaagatgacaatcctgcggctgcactccttcgatttgtgtcaaacgtgggaataaataatctagttctgggttcctgctcatcgaatgcctttgcaaggaagctgaagggagcagcggtacctgctactgttcttacctgtgctcctgaaacttgtgatgtttatgttatatctaga

SEQ ID NO: 226 - DNA, 614 bp, Eucalyptus grandis
ttcagtgtagatcaagacagggcaaacacgaacagggtcgttggaacctatggatacatggcaccggagtatgcaatgcaaggactcttttctgtaaaatcagacgtcttcagttttggagttctcttgctagagatagtaagtgggcgcaagaataatgattttcatctccaagtaaagggtgaaagccttctcacatttgcatggaagttgtggtccgaaggtcgagcattggaacttatcgatccgttaattgatgagtcatgtgatgaagttgaagtgctgaaatgcatacacatcggtctattgtgtgtccaagaagacccggcggatcgactgactatgtcactcgtggttcatattttagctggcgatactatcacactcagcccaccatcgctgcctgcattctctgttgggagagatgcggaaaaacttgatcgtgcctcaactgttaatgaagtaaccctttcggttgttgccgcgagccgatcaagttttatacaatggaaatgctgttagagataattatggtatattttgtcttttaggactgtgtatatatatttccattgtaatatatttatatcctcctactttctatattttttatc

SEQ ID NO: 227 - DNA, 535 bp, Eucalyptus grandis
gagatcccgggcagcatttttgctctgaggaacttgagcaagttgtacgtgtacaataccaatgtgtccgggtcgatccctcaatcagtgagtgctgcgaacctgagcaggattgatctatcttttaataacttgacggggaacatacctgaagattttgggaagctcaagaatctatcctgcttgagtttgcagttcaatcaattatccggtggaatccccgaaggtattgggcgtcttcccgctttgtctgatgtcaggctgtccaaaaacaatctatcaggcacgatcccccccgacttcggcaagttttccccactcagaagatttgaagtggccttcaacagcttgactggcgcattgcctgaacaactgtgccatggcggcacgctgttcgggttggccgttatggacaacaatctcggcggggagttgccggagtcacttggaaattgcagtactttgtctgtagcaatgttgaataacaatgggttcaccggcaatgtgcctggaggactctggatgttgcggaact

SEQ ID NO: 228 - DNA, 489 bp, Eucalyptus grandis
gagcaaatggacgtttacagctttggtgttgtgttgttggagctagtgactggccgacaagcagagcaaaaggagctggccgagtctgttgatatcgtgaagtgggttcgacggaaaatcaacctcacaaacggggctctacaggttcttgaccccaagatatcaagctcctcccaaaaggaaatgctgggagcactggagatcgctctgcgctgcacatctgtggcaccggagaaacgaccatcaatgactgaagtcatcagaaatcttcagttacacggttctaagggtagctctccgagtttggagttctctgcctcagagaacccaatgtcagtgtgaacgttaaagccaaaagtccctgcatgtaaattcgacttttttcagcatgtctctcttttttatttttgatggtctggaaaagaacgcctgagaactttctctcagatgaagaatggcatcttcattttcgtgaaaaaaaaaaaaaaa

SEQ ID NO: 229 - DNA, 531 bp, Eucalyptus grandis
gacacataccagcaatactgattgcatcggaaaaccaggaaagatggttttcaaatttcacaccatcgattttaccgaggatgtcgattttaacgctctgtttgctccttctcctcctccgtcgtccaccgtttgccttccacttggcaagagcttcacccgaaccatggctgtcgcaggcagagccgctgaaggcgtttcttgcgggttcactgtccctgccgtcgaggtttcttgctggaggccgaagacatcatacgacgactcgaatctccaactacttcatccccaggtacagcttcgaaaatttacataccaggaactgaaagtcgcgactggcaatttcagcaatcttttgggaagagattgctggggtatgatctacagaggaattttgcttgatggatctgtggtggcaataaaaagatatcgccgagcatctgactatgctgaagtgtgtgcttgtgctgaagtgcagattttgagtattgccaggcaccggaatctgatccaggtgctcggcttttgcga

SEQ ID NO: 230 - DNA, 360 bp, Eucalyptus grandis
gacaattccttctacggaccgtcgcggggccgtcgctctcgctctgctcgcacctccagtggctcaacatctccagcaactacttcgtcggccagctgccggacctctcgcccgggttcgccgacctccggttcctcgacctatcgtacaacaacttcaccggcgcgtttccggctagcttcggccggttgccggcgctgagcgccctgtcgctgttcgggaacttgctcaacggctcgataccttctttcttgggtaatcttagccagttgactcagctcaatatcggttacaacccgtacgcacaggcccctctgccttcggcgatcggaaacctgtccaggctcgagaatctctggg

SEQ ID NO: 231 - DNA, 527 bp, Eucalyptus grandis
gaaagatcaattgcgctattcttgtgtgcgtcgattgcttctttagctccggcaatcatgttgctggttcaagcccagataaatccagaaggtttcataagcatcgattgcggggcgagtaatccatacaccgacgacacgaccaaaatatactacgagacggaccaagaattcacggagtcagggaggagcatgaatgtatccctggctgctgggccacgatttttggagaccctgaggagcttccccgatgggatgaggaactgttactcgttgaagccggaacaaggcgagaacaagccttacttgatcagggcatcattcttgtatggaagctatgatgggaagaaccaaactccgacatttgacctatacatcgacgttaataaatggtccaccataaattcttactattacgagaagagagagatagtgtatgtggcccaaagagatgttgtacaggtttgcgtcgtgaatattggcaaaggagtgcccttcatttcggcattggagcttaagcctcttaa

SEQ ID NO: 232 - DNA, 596 bp, Eucalyptus grandis
gtccttttcgttcggtataagctggtccggaggctttgcataaaaagctttctggcctaccgtcgtcatcaatgaagcgctcgtcggatctcacgatcttgttttgggttgcatggcttgttacggcagtcgctgcggtggaggacgatatccagtgcctgcagggcctcaaggcctcgcttggcgacccacaagggaagctgagttcttggaggttcgcgagctcgtcggtcgggttcatatgcaagttcgtgggcgtttcttgctggaacgaccgagagaaccgcatactcagcctcgagctccggggcatggacttcacagggcagattccggagtcgctgcagtattgccggagcttgcagaccttggatctctccaacaatggcctctctggtacaatccctcctcaaatatgcaggtggcttccttacttggtgactcttgatctgtcgagcaatggcctttcgggctctataccacccgacctagtgaactgcacttacttgaacaatcttgtgctgtcgaataatcgcctgaccggcactataccatatgattttttgactctgagtaggctcaagaagttctcggcg

SEQ ID NO: 233 - DNA, 449 bp, Eucalyptus grandis
gttcaagaggccacaaacaactttgatgaaagttgggtcattggtattggtggttttggaaaagtgtaccggggagatttgaatgacggaacaagagtagctgttaagaggggtaatcctcggtcccaacagggacttgcagaattccaaaccgaaattgagatgctttcacagtttcgccaccgccatctggtttctttgattgggtattgtgatgaaaagagtgagatgattttgatttatgaatacatggagaacggcacgctgaagagccatctttatggctctagcgttcctagcctgagctggaaccaaaggcttgaaatatgcattggttctgctagagggctccactacctccacactggctatgcaaaggcggtcatccatcgcgatgtgaagtctgcaaatattttgcttgatgagaacctcatggcaaaagttgctga

SEQ ID NO: 234 - DNA, 282 bp, Eucalyptus grandis
tcatatatcgtgattttaaggcttccaatattctgctggatttggaatataatgcaaaactttcagactttggcttggcaaaggcaggccccactggtgatcggactcatgtttcaactcaagtgatgggtactcaaggttatgctgctcctgaatatatagcaacagggcgtttgactgcacggtgtgatgtgtacagctttggggttgtgctgctggagttgctctcaggacgtcgcactgtcgataaatcaaaagtcggggtggagcaaaatctcgtgg

SEQ ID NO: 235 - DNA, 349 bp, Eucalyptus grandis
gggattcctgttgtcattaaaaaggttgacctacgttctatcagaaaggaagtttaccctgttgaattggatttctttagtaaggtttcccatggaaggtttgtaccatttttgggacactgcctggagagtgagaatgagaagttcctggtttacaaatatatgcccaatgaagacttggcaagttctttatttaggaaaaccagctcagaggacgatactttgcaatctctggactggattaagagactaaagatcgcagtaggagctgcagagggtctatcttatcttcatcatgaatgtttgccccctctcgtgcacagggatgttcacgcgagtagtatacttc

SEQ ID NO: 236 - DNA, 544 bp, Eucalyptus grandis
ggcgagcagcggtacaaggagttcgtggcggaggtgcaggcgatcgggcgggtgaagcaccccaacgtggtgaagctgcgggcttactactgggcccccgacgagaagctcctcatcagcgacttcatctccaatggcaatctcgcctccgctctacgaggtaaaagtggccagccttcgtcgagcctttcttggtcaaccaggctgcgaatcgccaaagggaccgcccgaggattggcctacctccacgaatgcagccctcggaaattcgtgcacggggacgtcaagccatccaacatcctcctcgacaacgaattccaagcctacatctccgattttggcctcaacaggctcatctccatcaccggcaacaacccatcttccggaggcttcatcggtggggccctgccttacttcaagtcggtccagccagagaaggccaacaactaccgagccccagaggcccgcgtgcctggcagcaggccgacacaagaagtgggacatctactccgttcggggttgtcttgctcgagttttttttttt

SEQ ID NO: 237 - DNA, 475 bp, Eucalyptus grandis
gaaccgcaacatccaaatagtcatcgccgcggccgcaggcttcatctgcgcctccctcttcttcatcttcctcgccttcacctgcagccgccgcaagcggaaccgtggccgtgagctccaagtccagaccggctgcatgccggaagagctatcatccatcgccgtcgatgggagtgccttcttcgaccccaagctccggatctccatggccgagctccggacggtcaccaagaacttccaccccaagaagatcatcggcgacggcggcttcggcctcgtctacaagggccgcctcgccaacggcctcaccgttgccatcaagaagctcgagcccgacgccttcgaggggttccaggagttcatggcggagatggaaaccttaggcaagcttcagcacccgaacatcgtcaaactcctcggctactgcatgtcaaattcggatagggttttggtctatgagttcatagaaagaggg

SEQ ID NO: 238 - DNA, 592 bp, Eucalyptus grandis
ggtcagaacagtctctagttaggtgggctactcctcagcttcatgatattgattcactggcaaaaatggttgatcaagcattgaaggggatttatcctgccaagtctctttcaaggtttgctgatattattgccctttgtgttcagccggagccagaatttcgacctccaatgtctgaagtggtgcaagctttggttcgtttgatgcaacgtgcaagcctcaataagagaagatcaagtgatgaaccgggagcttctcacagacagctagatcatgatccttcagacatatccatttgaagacatagatatgcctgctgagaggtagctgtgcctgggtgtgatgggatcatgtaacctgtgcagtaacagtgtctaatacgactcactatagggctcgagcggccgcccgggcaggtaccaccaaagcccatttttaaactgtccatgcatgtctttggtaaagactctttgaaaagtttgtttgaataaggaagtattgaaagaatcaccccattaccatgtatcctccagtaaggttgggacagcatttcatctccaggagacctgtctgatctaatgcacacgcatag

SEQ ID NO: 239 - DNA, 420 bp, Eucalyptus grandis
gagccctctcccaattaaccgaccatccatgaggagggtcgtcaagatgttgcaagaaatcagtgctgaaaacgcgccgaagaaagtcattaaagatggcaaattgacgccttattactatgacgacgcctcggatccaggaagcgtggcttgagaagtttttacccctctttgtcacgggaaggagaaactattctccttttgaattttgcagagtaccctcagtactcagtcatcctgcctgatgctttgcttcgacgaccgatgaagaaatcaaaagccagaggaagagttttttctttttcaaggtggaaatatccaagaaagaagaggggttggccagaaaagaaagaagtttagtgcatatttacacctgtaaagtttaatatcatcatttgaattttcaaatccactgagttt

SEQ ID NO: 240 - DNA, 435 bp, Eucalyptus grandis
cttgattggattacccgattaaaaattgcaataggagctgcagaagctctatcatacctacatcatgaatgttaccctcctcttgtgcacagagatgttcaagtgggcagcatacttctcgatgataaatttgaagtgcgggttggaagtctgagtgaggttcgtgcccaagatgaagattctcatggtaatgttatcacgagattgctccggaagcctcagacgtctgaacaggccctttctggatcctcgtcggctaattgtgcttatgatgtgttttgtttcgggaaagtcttactcgaacttgtaacgggcaagcttggcatcagcaaatcggatgatgccacaacaagagagtggttggagcacactctatcttacatcagcgtgcatgacaaggaattggtcacaaagatcatggacccgtctctgatt

SEQ ID NO: 241 - DNA, 388 bp, Eucalyptus grandis
cttgccgccatattgaaggccaagtcattcaaaaaaagcagttctggctcatggaagatgacagcattccagaagctggatttcaccgtttccgacgtccttgaatgtgtgaaggacggcaatgtgatagggagaggaggagctgggattgtgtatcatggcaaaatgccaaatggggtcgaaatcgccgtgaagaagcttttgggctttggcaaccacagccatgatcacgggttcagagccgaaattcaaacgctaggcaacattcggcacagaaacatagtgaggttgctagcgttctgttcgaacaaggaagccaatctattggtttatgagtacatgagaaatggaagcctaggggaggcattacatgggaagaaaggcacat

SEQ ID NO: 242 - DNA, 750 bp, Eucalyptus grandis
gtgaacttggacgtggtgggtttggagctgtctatagaaccgtgcttcgagatgggcgagcggttgccattaagaagctcactgtctcaagcctggtgaagtcgcaagacgagttcgaaaaagaagtgaagaagcttggaaagatcaggcactctaacctcgtggcacttgaaggttactactggactccatctttgcaactcctgatatccgagtttgtatctggtgggaatttgtataagcatctccatgaaggatcaggtgggaacttactctcatggaatgaacgctttaatattatacttgggacggcaagaggcttggctcatttgcaccaaatgagcatcattcactacaacataaaatcgagcaacattctgatagagagttctggtgaacctaaagtggcggattttgggctggcaagacttttgccaatgctggaccgttatgtcttaagcagcaagattcagagtgcgcttggttacatggcaccggagtttgcttgtagaaccgtgaaaataacggagaaatgtgatgtttatggtttcggggttttagctcttgaaattgtcacggggaaaaggcctgttgagtacatggaagatgatgtggtggttctgtgtgatatggtgagaggggcacttgaagaaggcagggtcgaggaatgtattgatgggaggctacaagggaacttcccgtcagaagaggcgatcccggtgatgaaactgggtttgatatgcacgtcgc

SEQ ID NO: 243 - DNA, 493 bp, Eucalyptus grandis
ccaagcagagaaagaattcagagtggaagttgaagccattgggcatgtgcgccataagaatttggttcgtcttcttgggtactgcattgaagggacacataggatgttggtgtatgagtatgtcaacaatggaaacctggagcagtggcttcatggagctatgcgccagcagggatatctcacttgggaagctcgaataaaggttctgcttggcacagctaaagctctagcttacctgcatgaagccatagagcctaaagttgttcaccgagacatcaagtcgagcaatatattgatcgatgatgaattcaatgccaaggtgtctgattttggtctggccaagttgctgggtgaagggaaaagtcatgtcacaactcgagttatgggaacttttgggtatgtggctcctgagtatgcaaatactggtcttttaaatgaaaagagcgatgtctacagctttgggtggttctacttgaggcaatcactggtcgag

SEQ ID NO: 244 - DNA, 339 bp, Eucalyptus grandis
ggggacctagagaacaagagaggctccttttagctgactacatccagggagatagcttggcattgcatctttatgagacaacgcccaggaggtactccccattgtcgttcagccaaaggctaaaagttgccatcgatgttgctcgatgtctcacataccttcacgacaagggtcttcctcatggaaacttaaagccaacaaacatactcttgatggggcccgagtacaatgttctcctctcagattacggtctccaccgcttgatgacacctgctgggattgcagagcagatattgaatcttggcgcattggggtaccgtgctcctgagctcactactg

SEQ ID NO: 245 - DNA, 493 bp, Eucalyptus grandis
tgggtactgcattgaaggaattcacaggttgttggtgtacgagtatgtcaacaatggaaacctagagcaatggcttcatggagccatgcgtcaccatgggtatcttacctgggaagctcgcatgaagattctcctgggcactgccaaggcattggcttacttacatgaggcaattgagccaaaggtagtacatcgggacatcaagtcgagcaacatactgattgatgatgattttaatgcaaagatatccgattttggcctggcgaaactgcttggtgctggaaagagtcacatcacaactagagtcatgggaacttttgggtatgtagcaccagaatatgccaactctgggctattgaacgagaaaagtgatgtttacagctttggagtgctccttctggaagcaattactggacgagatcctgtagattatgggcgacctgcacccgaggtgaatttggttgactggctcaagatgatggttggaagcagg

SEQ ID NO: 246 - DNA, 481 bp, Eucalyptus grandis
caggcattccttgtgatcccatggttaatatactgctctccattgctcggccaatgggttaccctgttaaatttgctcaaggttggctagggaatagtgcttgtaactcatggacagggatttcatgttctgggggcaacatcgttgttattaatttccaaaatatgggtctttctggaactattgctcctgaatattctaacattacgtcgttggagaggttgttgctgtcccacaatagtcttaccggtacaatacctagtgagctcacaacgctgtctaatcttaaagtgctggacgtttcctacaacaatttgtccggtaaagtgcctacttttcggagcaatgtgaatataattaaagatggtaatccgaacataggtaaagacattgcgcctcctgcatcaccgacgactactcccccgggatccccgggtggttctgacaacaagaaatccagtgttgcgaggattgtggctcc

SEQ ID NO: 247 - DNA, 455 bp, Eucalyptus grandis
gctggatgcagacatgagggcaagagtcgcagattttgggttagcaaagcaaagcagagaaggacaatcccatcttactaccagggtggctggaactcatggctatttggctcccgagtatgcactttatggacagctgactgaaaagagtgatgtctatagtttcggagtggttgttttggaaacaatgtgtggtagaaaggctcttgatttgtcttcttcagggtcgccacgggcatttttgataacagattgggtctggtctctgataaaagctgggaagatagaagaagcatttgatccttcgttgttgaaagctggagagtctacaaattcgaacccaaagggcataatggagagatttgtgctggttggaatactgtgtgctcatgttatggtggctctaaggccaaccatcttggatgcactgaaaatgttggaaggagatattgaag

SEQ ID NO: 248 - DNA, 308 bp, Eucalyptus grandis
gttgtttcaggcggaggaaagcggccaagacgcatgaagccgtccaaggagatcaaagcggcgcgagtgaaatttcaaacgccgactccttgcagtatgatttagccactatacaaaccgccacagacaatttctctcatcaaaacaagttgggtgagggcggatttggcaaagttttccagggtaggcttcccaatggacaacaaatagctgtgaagagactatctcaaagctcaggacaaggtgctcaagaatttaagaatgaagtcctattggtagcgaagcttcaacatcggaaccttgtgcgg

SEQ ID NO: 249 - DNA, 380 bp, Eucalyptus grandis
gacaatctccactgctccatgacaatggaaagatctattacagctttctcgtttgcgttgcttgctggtttagcttcatcactagtccctgtggtccaagcccaacagattccaggttttatcagtattgattgtggggcaactaatgtatacaccgaggatgaaatcagaataagatacgaaaccgatgaagggttcatagactctggacaaaacaagcagatatccatgacgttcatacatgaaggctatcgacagtgcttgaataatttaaggagttttcccaacagaaagagaaattgttacactttaaaaccagaccaaggcaaaaacaacacctacttgattagggcaaggttttactatgggaactatgatga

SEQ ID NO: 250 - DNA, 492 bp, Eucalyptus grandis
ggcaccagggataatgtccgtttgttctgggccaaagaaaagccggactgcgggcgatgcacgaatcgtaagtggtgtcggcggaaagagagcggcaccaaatgcatcgatcctcctcgcagacacgaaggaaaaagaaatctagagatcaccggaggagtggtgggcttttttctctttcttgttggattaagcggactcggctatttcatcaatgaaaaaagaagagataaagcattccaactcaagatcgagagcttcttgcaagactacgaggccctcaagcccacccgttactcctacaatgacatcaagaggataaccaatgacttcgaggaaaaactaggccagggggcttacggaacggtctacaaagggaagctatcggacgagatttttgtcgccgtgaagatgctggacaattcattcgggaatggagaggagttcatcaacgaagtgagcacgatgggaaggattcaccacgtcaacgtg

SEQ ID NO: 251 - DNA, 937 bp, Eucalyptus grandis
agggcaatttgagtttcaacgagaggttcaagctcttagcaaactacagcatccacatctggtcaccttgcttggttcatgcccagaatcctggtctcttgtgtatgagtacctccctaatggaagtctccaagattaccttttccggaaaggcaacagttcctccttattatgggatgctcgagttcgaatcattgctgagatctcgactgctctttgcttcttgcactcttctaaacctgaaaggattgttcacggtgatctgaaacctgagaatgtccttcttgattctgatcttagctgcaagatatgtgatttcgggatttctaggcttgtagtggaggacactcttcgctgcccaagtttccgccgaatcacagagccaaagcgtgcttttccttatacagatccagagttctacagggatggaaacttgacgcccaaatctgatgtttattcttttggtctgatcatcctacaattactcactggtgaaccacctactgggttagtccgtgaggtgcataaagcaaaatcatccaacaaattggagtcggttttggatcaatcagctggacaatggccgtcgtctgtagcactgcgattagtggacctgggtcttcaatgctgtgattctaacggtaggaatcgacccaaattaacacctgcgtttgtgagggaattggagcagctgcatacctctgaagagcgaccggtgcccccattttacctgtgccccatccttcaggaaataatgcatgatcctcagattgcggcggatggtttcacttatgaaggagaagctatgcgggaatggttggacaacgaccacgatacatcgccaatgaccaacttgaagcttagtcatttgcatctcactcccaaccacgcgttacggtcggcaattcaagagtggctctgctatccctgagatttt

SEQ ID NO: 252 - DNA, 616 bp, Eucalyptus grandis
cgcggccgcgtcgacgccattgtcgattgcaaggaccgatggggcagcactcctcttgcagatgctatatactataaaaaacatgatgtgatcaaacttctggaggaaaatggtgcaaaacctttgatggcaccgatgcatgtcaaacatgctcgagaagttccagaatatgagatcaacccgaatgatctggattttaccagcagcaaggacataacaaaagggactttctgtctggcatcatggcgtggaactgaagttgccgtgaagaagtttcgagaggaagtgtttgcagatgaggacaaagtgagggctttcagggatgagcttgcaatccttcagaagattaggcatccaaatgttgtccaatttcttggtgctgtaactcaaagcagcccaatgatgatagtgatggaatatctaccaaagggagatctccgtgaatacttgacaagcagaagagcactaaggccatcaaaagcaattaggttcgctcttgatattgcaaggggaatgaactatttacatgaaaacaaaccagcaataatccatcgagaccttgaaccttcgaatattctgagggacgatgctggacatctaaaagtcgcagattttg

SEQ ID NO: 253 - DNA, 393 bp, Eucalyptus grandis
gtccggcataagaggttggtgaatttaattgggtgttgtgctgaaggggatgagcgcctattggtggcagagtacatgccaaatgatactctatccaagcatctgtttcactgggagcagcagccattgccttgggagatgcgggttagagttgcttactatattgcacaggcacttgaccattgcaatactgaaaaccggaagatctatcatgatttgaatgcatacagagttctctttgatgaggatggtgaccctcggttatcaagttttggccttatgaagaacagccgggatggaaaaagctacagtacaaatttggcttacactccaccagaatttctacggacaggaagggtcatccctgagagtgtgatttatagttatgggact

SEQ ID NO: 254 - DNA, 652 bp, Eucalyptus grandis
cagatctgcagccatgggcatcgtgaagttcctccgctccaagctgctgaacaggcgccgagccgccgtccacgttgagggcggggagagttgctcgggacggtgcggcgatgcggcggaggcagcagccgtgaagaggttggagtggggagagatcgagaggatcacggggcgcttctcggtggtggttggagaaggcgggttcagcaccgtgtacatggggcgtttgcccgtctgcgggggaggctccgccgctgccgcagctgtcaaagtccactgcggcggcggagagcggctcagcctggccttcaagctggagctggaggtgctgcttcggctcaagcacgagaacatcgtcaggatcctcggctattgcgatgatgcagatcaaggcgcgcttatattcgaatatgtctccggcggaaccctctatgatcgcctccacggccgcagcggcaataagcgctcgactctcccgtggaagagccgcgtgaagatcgccttccagctcgcgcaagccatcgaatatctccacgaaagatgcatcgtccacatcatccatggcgacatcaaatcctccaatgttttactggacggcgactccaattgcaagctctgcgacttcggatccgcaaaaatgggcttctcctct

SEQ ID NO: 255 - DNA, 402 bp, Eucalyptus grandis
atggttacacgtacaaggtgaatgagaagagcgacgtctacagcttcggggtggtgctaatggagcttgtgataggaaagaggccaatcgaaccggagtacggggagaacagggacatagtgaactgggtctcgagcaagttgaagacgaggcaagacgtgtttggcatcgtggactcgagaatcccggagccgttcaaggaagaggccatcaacgtgttgaggattgccatcctctgcacgacgaaactcccgaacctgaggccctcgatgaggagcgtggttcagatgctggaggacgcggaaccatgcaatttggtccgcgtggtcgttgagaaagacggcgacgggaaggcagaagtcaccgacagcaagaagatcaagccaagagccatgagagcct

SEQ ID NO: 256 - DNA, 668 bp, Eucalyptus grandis
gtgtttttttctgtcctaacacgttcacgactttcgttcttggactagaccatggctgccaacaagctctttcctgttgtcttctccgttatcttcgtgattctctctgctttgctccctactccctgtctctgctacgagcctcgcaaccatgaagtggaggctttgatcggtgtgaggagagagttgaacgacccacatggagttttgaacaactgggatgaagattctgtcgacccctgcagttgggccatgatcacttgctcgagtgacaatctagtcattggcttaggagctcctagccagtctttatcgggaagtctgtctgagactataagaaatctcaccaatctccgacaagtgctactgcaaaacaacaatatctcaggcggcatcccaccggagttgggtactcttccaagactcgagactttggatctctccaacaatcacttgtctggtccaattcctgagtctctagggcaattgcgtagtctgcaatatctgaggctaaacaataatagcttgtctggtgctttccctgtgtctttggccaaaatcccactgcttgctttcctggacttgtcttacaataatctcagtggaccggtgcccaaatttcctgctagaacattcaatgttgtgggaaacccattgatatgtggaag

SEQ ID NO: 257 - DNA, 624 bp, Eucalyptus grandis
tgacaatggaccaggacggaaatctgaggctcttcagcttggacaagcagtctgggtcgtgggtggtgacatggcaggcgcttccgggattgtgcaatgtgcacggaatatgtgggaggaatgggatttgtgtatacacacctgagcccaagtgcacatgccctcctggttatgagatgagcgagcctactgactggaacaaaggttgcaagcccaagttcaatttcacctgctccaagtctcaggacgtgaagttcttggcgcttcccaacacggactattatgggtttgatgccatctacaacgacaacgcctcgttcaatttctgcaggcaggcctgtttggatgactgcagctgcttggggttcagctaccgggaatcgcaaagattttgtttcgggaagagatcgctcttcaacggctacaagcaaccgtcttttcccggaactttacatctgaagttgcccatctccatggtggcatccttggagcagattcgcaacggcagcaatcctgattgctccaaggccagagatcaattaatggttggttcatcgaccatgtatgacactataagcaagagggtgagatgggcctacctctactggttcgcatctgcgattg

SEQ ID NO: 258 - DNA, 449 bp, Eucalyptus grandis
tatggctacatcgccctgagtatgcatacaccatgaagttcgagaagtgcgacatctatagcttatggagtcgtcttgctggagctgctgacgggaagactccggtgcaacccctggaccaaggcggggacctcgtgacttgggtgcgaaattacatccaggaccactcgttatctcccggagtgcttgatgtgcgagtggacttacaggacgagagcactgtatcccacatgatcacggtcttgaagatcgctctgcgttgcacaagcatgtctccatcggatcgtccaacaatgcgggaagtcgtcgcaaagctcattgagtctggtgagaaggaagggaagttttactgttatcctagtgatgatactgactcgagagatgaatcttgaatactttacagaataacacgcaattttaaagttctctctcttaaaaaaaaaaaaaaa

SEQ ID NO: 259 - DNA, 164 bp, Eucalyptus grandis
ttcgagctttcttggaaacaaagggctttgtggagagccattgaccttctcatgtgggagctctagtgggcctgaccatgaaggttaccgtcacagggtttcttacagaatcatactagccgttgttggctctggtttggcagtttttgtgtccgttactatag

SEQ ID NO: 260 - DNA, 488 bp, Eucalyptus grandis
gttgtgtcacgcccatcatccatagagatatcaagacgacaaatatcttgttgaatgaaaacatgcaagccaaaatatccgacttcggtctgtcaagaggattgaaagctgcaaatagtacttatgagtcatccagtcctttaggcactcccggctacctgcccccggagtatcaaccatctgcctataaattaaaccagaaaagtgatgtcttcagttttgggatcgtgctcctcgagctaatgacaggacaacaagcaatgatgccaggtggagagggagaaggcgtgcccatacgtggatgggcaatttcgatcatcaaaagtggggatatgcatagacttatggatcgacggttacaaggaaaattcgacattggctcggctcagatagcagcaagggttgcggagtcttgtacgtgtgaagaagccgatacaaggccagacataagtcatgtattggcagatttgaaaggggcgattgaattg

SEQ ID NO: 261 - DNA, 364 bp, Eucalyptus grandis
gaaaagcagcagtccgtggccgtttgcgttcccgagcttcttgctctgcttatccctctgcactacccacctctgtctcggctctggctccgataccatctccgccaaccagtccctcccaggcagccagaccttactctcctccggcggcaacttcgagctcggcttcttctcgctgggtaactccacgtactcctacataggcatctggtacaaaaaagtcagcgtgccaaccatcgtctgggtcgccaacagagagaaccctgtcaccgacaggaacgccactgagctgaagatctcggggggcaatcttgtgatggtcaacgactccgcagtccccgtttggtccacgaatctgactgct

SEQ ID NO: 262 - DNA, 1834 bp, Eucalyptus grandis
ctcaagcacgctctgcaaggacaccagaacgctgcagcgaaggcgacgagaatggcggaagttgtcgaaggcggggcttcttctcacgatgtgcagtccctcttgtcttctccggacagggacttcctcatccggaacaacggcgatcaggttaaggtcgatagcttgaaggggaagaagatcggcttgtacttctccgcgtcgtggtgtggtccgtgccaccggttcaccccgattctggcggaggtgtacaatgaacttgccccaagaggtgacctggaaatcatttttatctcggcagatgaggatgaggaggccttcagcagatacttttccaagatgccatggcttgcaataccattttccgactcagagaagcgcgatagcttggatgaattgtttaaggtcaggggaataccgcaccttgttgttcttgatggcacaggtacagtcttaacagatagtggagtggagatcgtccgtgagtatggagtggagggtcatcctttcactccagaacgcgtcaaagaattgaaagaccaggaagaagctgctaagagaaaccaatcagtgacctctcttttggtcgatgggtctcgtgacttcgtagtttcatctgatgggaagaaggttcctgttgctgagcttgaagggaaaaccgtgggtctatatttttcattgtccatttacaaatcatgcattgatttcacgccaattttactggatgttcatgagaagctgaaggccaaaggagagagatttgagatcgttcagatacctctagatgatgatgacgaatcattcaaccaagcctttggaagcatgccgtggctttcattaccattgaaagacaaaaaatgtgagaaattggttaggtactttgagctttctaccctacccactcttgtcataatcggtcctgatgggaagactctccgttccaatgttgctgaaactgtcgaagagcatggggttgaagcttacccattcactccagaaaagtttgcagagcttgcagagatacagaggaaaaaggaagaatctcagaccttggagtcaatcttggtttcaggggatcgagatttcgtcattggaaaggaaggaaccaagattccagtattggacttggtagggaagactgtcctcctttacttctcagcacactggtgccctccttgccgtgatttcctgccagtgctcacggaggcatacgaaaagatcaaggccaaaaacaatgcctttgagctgatcttcatctccagcgataaggaccaagctgccttcgacaattactatgctcagatgccgtggctggcgcttccctttggcgacgagaggaagaaatccctgaatcgcaaattcaaggttgacgggatccccacgctcatagccattggcccgacgggccggacactgactaaagaagcaagaaatcttatatcggagcatggggccgatgcttatccttttaccaccgaacatctgaagaagttggagaagtcgactaagatcgagctggatgaagaagaagacgaagaagacgataaagcagctggggaggaggcaaaggaaggaggagaagccggtgaaggatgggtctgtgatggtgaagtctgctacaaagcctaaaagttacttcttagttgttctgtcttctgttactcgtttgaagcagttttctcgtttttttttatgtgagtggacctgtttcgagcttcatatgcggagggttcgcataagggatgtacattattcatactttgggtgtgttattatgtgactttgacaattcgcagtcgtaataaaatctttatcttataaaaaaaaaaaaaaa

SEQ ID NO: 263 - DNA, 854 bp, Eucalyptus grandis
gagcttcaagttgtggcacttcaaactacttcttcaggccctgtggaagaagtagaagaattggcatactcattggagggcttactgctggagcttccttaatggctactcttgctgttatctgtttctttgcccatcgccggtccactactcagcgcaaccagataagtgcgaagcgccttctccgcgacgcagccggcaactccagtcttcccttataccagtacaaagacatcgaaagatccaccaatggattctctgagggacagaggctgggtactggggcctacggcacagtctatgctggaaatatccacaatgacgagtgggtcgctattaagaagatccggcatagggacacagatagcattgaccaagtcttgaatgaaatcaagctcctatcgtccgtgagtcatcccaatcttgtccgtctcttgggttgctgcattgagcagggcgaacagatccttgtttacgagtacatgccaaatggaacattgtctcagcatttacaaagagagagagggaaaggacttccttggacgacaaggctcaccatcgcggctgaaactgctcgtgccattgcctatctccattcagctgtgaacccacccatctatcatagagacatcaagtctagcaacatactcttggattaccaatatagatccaaagtagcagattttggcctttccaggctgggaatgacggagactggggattcccacatctctactgccccacaagggactccagggtacctcgatcctcaatatcatcaaatttccatctgtccgacaagagtgacgtctacagttttggggtggtccttgtggaaatcttaaccgcactaa

SEQ ID NO: 264 - DNA, 382 bp, Eucalyptus grandis
gtcgaggtcacggtcaagaaacctaaagatgtgcacaagcctctaatgaagaagggattccaagatgaacttaaaattgtgacgcaaacaaaatacaaatatgtggcgaggctctatggcatatgtttggagactagaatacccttgctagtttatgaatacattttgaatggtaccctctttgaacacatccatctgaaaatgtcaaccatcttgagatcatgggaaaaccgactcagaatagctgctgaagttgcacttgcgctcaaggaaatgcattccagcgaaatcattcatggcaacatcaagtcaatgaatatacttctagatcaaaattactcggtgaaaatatctgattttggaacttcagtacttatatcac

SEQ ID NO: 265 - DNA, 557 bp, Eucalyptus grandis
aagaagtggggctaatgagcctgggaaacctcaagaccttcactttcaaagagctgcaattggcgacagacaatttcagctccaagaacatacttggtactggaggtttcggcaatgtatacaaggggaagcttggggatgggactatggtcgcggtgaaacgcctgaaagatgtagttgggacaactggagagttgcagttccggactgaactggagatgatcagcttggcagtccatcgcaacttgctgcgattgattggatactgcgccacttcgaacgaaaggcttctggtctaccctcacatgtccaatggtagtgttgcttcaaggctcaaagcaaaaccagcgctagattggaacacgagaaagaggatagccattggagctgcccggggtctcctgtacctgcacgagcaatgcgacccaaaaataatccacagagacgtgaaggcagctaatgtgctccttgatgactattgtgaggctgtcgtcggtgattttggcctcgcgaagctcctggaccatgctgactcccatgtcacgactgcagttcgt

SEQ ID NO: 266 - DNA, 511 bp, Eucalyptus grandis
gaaacggctaccacatccaaggaaggcagcaggcggtctacctttaccatcagctccagcagataatggttttgttatatatcacaatcttgggcgcaataacttcactggaacattgagctcaatgccgattatccctaggaggctgaatgctcaaatgatttatgccctttttgctggagagaacaatctttctggaccatttcctgaaaatatatttgagaactgtcaaaacttggacataattgccatcaatatcagttacaacaaagtctctgctccgattccgtctggcatgggtaaatcgtgccgatcgcgcattcttttggatgcatctcggaatcaaattcctggttctattcccccaagtcttggagagctgctttcttttgtcgggttaaatctcagctggaattcattgcaaggtcagatcccacccagtctaggtcaagtgaagggtttgaaatatctttctttggctcataataatcttactggctccataccaccc

SEQ ID NO: 267 - DNA, 407 bp, Eucalyptus grandis
gatttgtccttcaacgatctctccggcgaagtcccccacgaaggccagttcctcgtcttcaagaactcctccttcgccggaaaccagaaactctgctcgccaggccgcttctcttgcccttcgcggtcaagtgcctcgcgcacttcctcgagggttgtgatcacggcaatctcactcgtgaccgcggcgctgctcatcaccgtcacggtctaccaggtcctgaagaggaggcggcagggctcgagagcctggaagctcactgccttccagaagctcggcttcaaggccgaggacgtgctcaagtgcctggaggaggagaatatcatcggcaaaggtggcgcggggatcgtctaccgcgggtcgatgcccaacgggacggacgtcgccatcaagcagctggcgggacg

SEQ ID NO: 268 - DNA, 1107 bp, Eucalyptus grandis
catgcacgagaagcacgagaagaagaaaactccaagcgacggcgctgttcacgcacgattcccgccggcctcgtcgccgtcctctgctgctgtccgcctgcgacgtcaaaacgcgacgcggccctcctcatcttcgattctctgtccccccctctctgtctctcgcgtttgccatagctgagaaaagcttcgagtgtgccattttcttgaaaagacaaagctccccatttcgagcaaagacccaccaccatccatccgcgagccatgacgctctccctcctcctctctctcctcttctccctcgccttcctccactgctgccgccaccctcctcgcgcgctttcctcgcccctctcggagctccacgccctcatggcactcaaggccgccctcgacccctccggccgggtcctcacctcgtggtcccgcggcgccgacccctgcggcggcggcgcgtcgttcgagggggtggcgtgcgacgagcgcggccgcgtggtgaacgtctcgctgcaggggaagggcctgagggggcggatcccgccggagatcggcgggctcgggagcctgaccgggctgtacctgcacttcaacgccctgggcggcgaggtgcccggggagatcggagggctgaggatgctgaccgacttgtacctggacgtcaatggattctccggggagattcctcccgacatcgccaacttgactaatctccaagttttgcagctgggctacaaccggttctccggcggcatccctagacagctagggtccctgccgaagctgaccgtcctcgctttgcagtacaatcgcctgaccggcgccatccccgcgagcttgggggactcggcgaacctgaagaggttggacttgagctacaacaatttcttcggctcgatcccggcgacattgaccaatgcttctagtctcgaagtcctggacgtgcgcaacaataccctgtcgggctatgtccctaccggcttgaagaggctcgatgatggtttccaatatgaaaacaaccctgacctatgtggagtcgggttccccaacgtccgaccctgtccgaccgtttacctggaccggcccgagccgctccgacccgatactctt

SEQ ID NO: 269 - DNA, 671 bp, Eucalyptus grandis
gtggaataccttaagtttctattcatactagagactcacttcacagccaagagacgttattgcagagatttatcattctatctgcaccatcacttgcttcaagcagatttggactaatctagccttagcccatctgggttttctgtgcttctgatgaatctcaatacgatgagactgaagagaggtgaagaagccgctttgtgtttagtggccttcttgtggatttggaattcggcaaatggattgctctctcccaaaggtgtgaactttgaagtgcaagctctgatgcgcataaaggactgtctacatgatcctcacaatgtgcttgagaattgggataaggatgctgttgatccatgtagctggactatggtcacatgttcaactgacagtttagttgttggactgggaactcctagccagagcttgtctggtactctttctccaagcataggcaacttgacaaaccttcagatcgtgctcttacagaacaacaacataatggggccgcttcctccagagctcgggaggctttcgaggcttcgcactctcgatctttccaataatttcttcaccggagaaatcccctcctcactgggtcatctgaacagtcttcagtacatgaggcttaacaacaatagtctctccggtgcattcccgagctctttggc

SEQ ID NO: 270 - DNA, 841 bp, Eucalyptus grandis
gatctctcttcttcctttcttctgtcttcttagctcactcagcagattcgctgattttgagaacttgactgcttcaagcagtatgaaagcttttgtggcgctttccatgtgtcctgttctcttcttctcttgtaatgcccttctttccaatgcactagataccataacaacaaatcagtcgattcgagatggcgagaacctactctctgctggtgggacatttgagctggggttcttcagtgcaggcaatcccccaaagcggtatctgggaatatggtacaagaaaataaccacaacgacaatagtgtgggttgcaaatagagtcgcaccccttgcggatgcatcaggtactttgaggattactagccgcggaagtctcgtccttctcaacgggaatggaagtgatatctggtcgtcgaactcgacaatactggtgcgtaatccagttgcacagctcttggattcaggaaatctggttgtgagagatgcagatggcagtgatcccaataatgtcctgtggcagagttttgactatcctacagatacatttctagccggtatgaagataggatggaatagaacttcaggcttcaatcgttatttaacatcatggaagagcattgatgatccttctccgggcaacttcacgtatcaaatcgatccgaacggctacccacaactcctactgaagcagggttctgacatcaagttcaggtcaggaccatggaatggtcttcgatggagtggcacgcctaatttaaatccaaacccatactacaggtacgaatttgtcttaaatgaggaagagatgtactaccgctacgagctcctcaacagttcg

SEQ ID NO: 271 - DNA, 371 bp, Eucalyptus grandis
ctggaacttatggatatatggcaccggagtacgcaatgcatggttacctcactgacaaagccgacatctatagttttggcattgttgccttagaagttgttagtggccagagcaacagtagctcccaaaaaactgaggaatgctttattctactcgattgggcacactttctgaaggagagaggaaatttgatagaactagttgatccgaggcttggttctcactttgacaaagaggaagcgttggcattgataaagatagctctgatgtgtacttatgtgactccagcactaaggccgccaatgtcatatgtggtagcagtgctggactctgcgggcgctatcatgactgaggagaaattgaggcatgag

SEQ ID NO: 272 - DNA, 353 bp, Eucalyptus grandis
gattctcagaggttaaaggaattccaaaccgaggtcgaagcaatagcgaagatcaagcactcgaatatcgtgcctctccgagcttattgctggtctggcgatgagaagctgctcatatacgatttcatacccaatggtgacctctctgcagcagtacatgggaaggctgggacaacaaattcaatgccgctttcatggagcacacgtctcaggatcatgaaaggagtagcaaaaggcatagcccatcttcatgagttcagtccaaaaaggtacgtccatggagacttgaaaccgagcaatgtactgcttgggaagaatatgaagcccttcatctctgattttggcatcagtcg

SEQ ID NO: 273 - DNA, 443 bp, Eucalyptus grandis
ttgatgactattgcgaggctgtggtcggagatttcgggctggctaagcttttggatcaccaggactcacatgtcaccacggccgtgagaggcacagtgggtcatatagcccctgagtatctctccacggggcaatcctctgagaagacggatgtgtttgggtttgggattcttctccttgaattgatcactggacagagagcactagagttcggcaaggctgctaatcagaaaggagcgatgctcgattgggtgaagaaaattcatcaagagaagaaattggaaatgcttgtcgacaaggacctccgaagcaactatgatcggattgagctcgaggaaatagtacaagtagcactcctatgcacccagtaccttcctgctcacaggccaaagatgtcggaagtggtccgaatgctcgaaggtgatggcctcgcggaaagatgg

SEQ ID NO: 274 - DNA, 717 bp, Eucalyptus grandis
gagatgtcgagcctcatgcacgtggacctcaggaacaacaggatctcaggcccgatccctgcggacttcgggaagctgacgatgctgagccgggcgctgctgggccggaaccagctgaatgggacgatcccgagctcgatagccaccatgtacaggctggcggacctggacctgtcgatgaaccatatcaacggttgggtcccggaggagctgggcaaaatgcgggtgctgtcgacgctgaccctggacagtaactggctgtcgggcaagttgccggcgagcctgttgagcgacgcgggcatgggaatactgaacctcagccggaactggatcgagggggagattccggacgtgttcgggtcgaactcgtatttcatggcgctggacttgtcgcacaacaatttgaaaggcaagataccgggatcgctgtcgtcggccaagtacatcggccacttggacctgagtcacaaccacctgtgcgggcccatccccattggcgagccgttcgagcacctcgaagcgtcgtcgtttgccaacaacgactgtctgtgcgggaatcccttgaggacttgttaatcccatactctgtttttttttttttttttacatgggtgtggtcgtccgagtttcaggacatgtcaagagcaggtcgacgagcttaacgtgtgtaatattattgtttaatgggaatcctaaggttgtgatataaaaaaaaaa

SEQ ID NO: 275 - DNA, 831 bp, Eucalyptus grandis
gtgtctccgattttgggctctcactgcttctgaatcccgttcatgccattgcgagattggggggataccgagctccggagcaggcagagaccaagcggctctctcaaaaagccgatgtctatggctttggcgtcctgttactggaagtcctcactggcagagctccatcgcagtatccatccccaacacggcctcgtgccgatgaagaagaacaggcagttgatctacccaaatgggtgagatctgtggtgaaggaggagtggactgctgaggtgttcgatcaggagcttcttcgctacaagaacatcgaagaggaactcgtttccatgcttcatgtaggcttggcctgcgcggcggctcagcccgataagaggcctttgatggcggaagtggtgaagatgattgaggacattagggtcgagcagtcaccattaggagaagactacgacgagtcgcgaaactcgctctctccttcgcttgcaacaaccgaagatgggctttgaagattcaaagtgatggatcagttaactgggttgttccgtgattggcttctgtttgttttttgcattgtctcattgctattgcatgcggtctgtcctgggtttaagtttgtaaaattgggttagcctaatgtacttttattattatccgtgggagaatttggggattttcaccaaattcgaccaatttgatctacacggtcagctattattcactggaggatgcacatcagtactcagtagtgttcccttctggtcagaaagcttcatttctgttctcaaattatggactgcactgaactctacttctgttatcgataaaaaaaaaaaa

SEQ ID NO: 276 - DNA, 894 bp, Eucalyptus grandis
tgtaaagcggctccttttcttggtcctttaaaataaagagaaaaagggcttcgctccactggccctctctttctccctctgtgttctttttttaatccgaacgttgctgacaaacggagtggcttttctccgttcctttcttctgggcaatttttcctctccctctcgcctctctgggactcgcgggagaagatacggatatgggaagagggctcttcctgggaagagggctcttcctgtgcttgctcgtcttctgcacttcagttcttatggagctctccactgctcagatgccaggttttgttagcttggattgtggaggatctcagagtttcactgatgagattgggcttgaatggactccggatgaccatttcacctttggagaaagaactaacgtttctctcacgaatgagacaagaacacaatatacgacattgagatacttcccagccgatgacagaaagtactgttacactttaaacgtgaccactaggacaagatacttaataagggcgacattcttgtatggggactttgacagcaataacgtctacccaaactttgagatctccttgggacctactttttggtccacaattgtcatttctgatgccagtactatagaagtgcgagagctcatatttctggcctcagatcctaccataagtgtgtgcttatctaatgctaccacgggcaacccattcatatctacccttgagcttcgtcagttcaatggttcgatgtactttactggctttgaaaaccagttctatctcagtacctctgcccggattaattttggtgcagaaagtgaagagccagtcaggtatccagatgatccattcgatagaatatgggagtctgactctgtaaagagagcaaactaccttg

SEQ ID NO: 277 - DNA, 660 bp, Eucalyptus grandis
gctcgtccgtcgtcgagcagcggcggagcacgagaagaagatggcggcgacggcggcgaaaccgccctgcaagcccgctccctcgcgcagagcgacctcgacgtgctcctgcagctcagggccgccctggccgcgcccaactcgaccgccctccacgactgggtcggcccctcctcctcctcctcatcctcctcgtcgccgccgccctttccgcattgctccttcaccggggtcacgtgcgacgccggctcccgggtcgtgtctctcaacctcactgacgtccgcctcttcggccgcgtcccccgcgaaatcggcctcctccgcgacctcgtcaacctcacgctcaccagctgcaacctctcggggaccctcccgccggagctcggcaacctgaccgagctcgaagtcctcgacgtgtacgacaacaacttcacggcccagctgccgccggaggtggtggggctgaagaagctgaagtggctcaacctcgccggcaattacttcttcggcgagataccggaggtttactcggagatggagagcctggagtacctgggcctgcaggcgaaccagctgagcggcagagtcccggcgagcctcgcgaagctgaagaacctccagtggctctacctggctacttcaacacgtacgatggcgaga

SEQ ID NO: 278 - DNA, 961 bp, Eucalyptus grandis
gttccttcctcccccccaaagttaaaaaaaagggaagaatccaattcatccaatttccccccaaagcccctgcaatcatgaactcccaccattattgctttcgctaggcaacaaagatctcctctcttccccctctctttccacgcacattgtcaccctcatgcgcacagatctttccatgtgaacgccaccaccttctccttcaagccgcagtcgctccgccacctacgccgtcgcgccatgcatgtgacggtatatcgccgtcgcggcgagctcgcggctgccctgaggctcgtgctccgttcttggtccctgctgtgctgctgctgctgcttcttcttgttgcctctggccctcgccgccgacggcgactacgagatcttgctccgcgtcaaggccgcccacctcgaggacccggacggccagctcgacgactgggcccccaacgccgaccgcagcccctgcaactggaccggggtcacgtgcgagacccgcaaccgctctgtcgtcgcgattgacctctcgggactgaacctctccggtgggttcccgtacgacttctgccggatccggaccctccggaacctctcgctcggcttcaacttctttaacggcaccgtcgtggggccgtcgctctcgctctgctcgcacctccaggggctcaacatctccagcaacatcttcgtcggcgagctgccggacctctcgcctgggttcaccgacctccggttcctcgacctatcgttgaacaacttctccggcgagattccggctagcttcggccggttgccggcgctgagtgtcctctcgcttgtcgcgaacttgctcaacggctcgataccttctttcttgggtaatcttagccagttgactcagctcaatatcaagttacaacccgttcgtgccgggccctctgcctccggagatcggaaacctgtccaggctcgagaatctctgggct

SEQ ID NO: 279 - DNA, 525 bp, Eucalyptus grandis
cccgtctctccgggaagttgcatgcattaaatgggacttctgtttggctgctgataagagcactcatgatatttttcatttttgtatctgtgtttaagtaacaagaggctcagaaaaaaaaatgagaaaagtaaaaaatcaggactctattgacgattgctgctcattgtttttctttcattcccctctgaattattagaaggtttcataagcatcgattgcggggcgagtaatccatacaccgacgacacgaccaaaatatactacgagacggaccaagaattcacggagtcagggaggagcatgaatgtatccctggctgctgggccacgatttttggagaccctgaggagcttccccgatgggatgaggaactgttactcgttgaagccggaacaaggcgagaacaagccttacttgatcagggcatcattcttgtatggaagctatgatgggaagaaccaaactccgacatttgacctatacatcgacgttaataaatggtccaccataaattcttactat

SEQ ID NO: 280 - DNA, 944 bp, Eucalyptus grandis
cttctctccatctctcatctaaaaatcccgctcttccgctcctttagcaaatatagaaaatgcgccccttcttgctcctcctcctcctcctcctcctccacctccgccgcggcgccgccgcctccgccgcccccacccgcctgacggagccgctcgccctcctctccatcagggccgccgtcaccggcgacccccagtccgccctctcctcctggacctccgccgccgccgccaacggcagcagccactgctcgtggcagggcgtcacgtgcgacgcccgccggcgccacgtgaccgccctcgacctctcgtccctcgagctcgccggcgccctctccccggacgtcgcccacctccgcttcctcacctccctctccgtcgccgccaaccagctctccggccccataccgccgcagatctccgccctcgccgcgctgcgctacctcaacctctccaacaacgtcttcaacggcacgttcccgccccggctcggcctcctccggaacctccgcgtcctcgacctctacaacaacaacatgaccggagacctcccagtcgccgtcgccgagatgccccagctccgccatttgcacctcggggggaactacttcggcgggaggatcccgcccgagtatggccggtgggagttcatcgagtacctggccgtctccggcgacgagctaaccggcgccatcccgccggagatcgggaacctgacgacgctgcgagaactctatctcgggtactacaatagctacgacggaagcttgcccccggagattggtaacctgtctcaactcgtcaggctcgatgcggctagctgcggattgtccggcgagataccgctgagattgccaagctgcagaatctcgacactctgtttcttcaagtgaatgggtttgcagggtctctgcctgctgagataggctacttgaatagcctca

SEQ ID NO: 281 - DNA, 622 bp, Eucalyptus grandis
ggcagaaatcctaagctaggcagagtctccgacgataccaaacgatttatagttcctgcttctcttgtttcgtgatgggtttcttctaccaagtctttctcatatttctggcggtcgcgccgtctgctctgtgccaagttactgagttcgtcagcatagactgcggaggatccagcaactacacagacccgacaacagggctcgcatggatcccggacacgggtctcatgagctatggccagtcttcgaaggtgcagaatcccaacgtaagctcggtgcagtattcgacgcgcagggacttcccaatagacggccagaagtactgttacaccctccggaccgaagagagaaggagatacatcgtccgtacgacgttcttgtacggcaacccggacaccggagcgacgttccccaagttcgacctctacttggacacgaccgagtggacgaccgtgaccatcttcgacgcagcccgagtttacgtgaaggagatgatcatacgggcaccttccgaatcggtcgatgtgtgcctgtgctgtgcgacgactggggctccgttcatttccactctggagctcaggccgttgaatctctcgatgtacgccactaatttcgaggataa

SEQ ID NO: 282 - DNA, 900 bp, Eucalyptus grandis
ccgagtcctaatggctccgccatcctcgctcctcctccctctcttcctctccctcttcctccaatcttgtcggctctccacctcggcgccgcccagcctccccaaacgcgcatccctctccgtggagaaccccgacgacctccttgtctccccctctggcgccttctccgctggcttcttccccgtcggccacaacgcctacggcttcgccgtctggttcagccaccccccctgctccggcgccgcctgcacgcccgtctggatggccaaccgtcaggcccctgtcaacggccgccgctccaccttatccctcctcaactcgggcagcctcgtcctcaccgacgccggcgccgaggtctggtcttccggcaccagctccccctccgccgccgagctccgcctcaatgacactgggaacctcttcctcaccgacggcagcggcggcgtcctgtggcagagcttcgactcgccgaccgacaccctcctccctcagcagcccttcactggaaaaacattcctgatctctgctcggagccggtacaactactcgaccgggttctacaagctttacttcgaccccaacaatgtcctccgcctcctcttcgacggcccgtcaatctcaagcgtctactggccttacccgtggttctcgaatgatcagcttggccgattcccctacaacagcagccgcatcgctgtgctcgacctgctcggccgcttccagtcctccgacaactactcgttctccacctccgattacggcgtcacggctatgcagagaaggatgaccctcgactttgatggcaacttgcgggtctacggccgcgagctgggctcgactgtctgggcccgtgacgtgggaagcgctcagcatccctgcttcatccacggcgtgtgcgg

SEQ ID NO: 283 - DNA, 795 bp, Eucalyptus grandis
ggaacaacgcgggctgctgtcgattgtatttgttatagtggttgcgctttgtccgctccggctttacgctttgttttctagctttttgttattcacttcgatggatcagctgaagactgaggagctcattttccttattctttaattagaatcccgttccatctctcttcacgttgatgtcagctcaggtgatctttctatcctttcttgattccccttatcagttcttcatcgatttattcgatagcttgcccctggaaacggttgtgtataagtctatgaattcgctttttagttcttgcccttcgaattctttttaagctgtcgccattgactggttttatttgaacttatccgacagcttttgatgatcaaggtccgtgaattcatgtcctgggaattgttctgcaaccatcttgaatagcccattttcattatccacctctccgagctgttccaaagatggggaatctgagttttcagttgatcctctcatgttcatacctcttctgtttgatttgtatagcttcaggatttgttccattggataattatctgatagactgtggatccccacggaatgcatccgttggtaatcgcacgtttttggcagataacttctactctgatatactttcgactgcacaaaacattcttgccaacacaaactcgagttctctttcatcctcctatgattcgactctgtatctcaccgccaggatcttcgaccaagcctcccgttacacttttccgataaaggaaaatggcaggcacttgattcgcctctatttcttc

SEQ ID NO: 284 - DNA, 689 bp, Eucalyptus grandis
caaaattgggttaggtataagctgacacatgcagtagacttcttagagggtgggctaaatttgtatatagagagttgtcagcttcttctgtttataatatggcggccctttccttcttctccgttgcctctcttttgtctccacatgcagtccccggtcgtgcgctgcgagaaagagaacattatgaagctcgtccattttaatgttatcgtctagcttgagagaggaaaaagaagaaaagaaagaagaaatttgcatgtgatgctgcctctacaagcaacggacagctcatcatttatcatcatgcccgccatcattgcactgaccttctgatgaagattggagtgacgagacacatctttttgctgaggaaggagtgtgaaggtgcttcaatcttccccagaagccagggaggctagaagagctgctcgttcttcttcgagcctaactattctccaagtatattgctgtgaactggctgtagaaaatggaagggaagcacctcgtttttctgacaattctcttgttggaatcgatttgctcgaatgtctcggcgatacccaacgaggataagcaagcattactggattttcttggcaatgtttccctctcgcgccctctcaattggaacaaggattcttctgtgtgccggtcctggacagggtcaagtgtaataacgaccaatcgag

SEQ ID NO: 285 - DNA, 499 bp, Eucalyptus grandis
cgcgggctgctgtcgattgtatttgtcatagtggttgcgctttgtccgctccggctttacgctttgttttctagctttttgttattcacttcgatggatcagctgaagactgaggagctcattttccttattctttaattagaatcccgttccatctctcttcacgttgatgtcagctcagcttttgatgatcaaggtccgtgaattcatgtcctgggaattgttctgcaaccatcttgaatagcccattttcattatccacctctccgagctgttccaaagatggggaatctgagttttcagttgatcctctcatgttcatacctcttctgtttgatttgtatagcttcaggatttgttccattggataattatctgatagactgtggatccccacggaatgcatccgttggtaatcgcacgtttttggcagataacttctactctgatatactttcgactgcacaaaacattcttgccaacacaaactcgagttctc

SEQ ID NO: 286 - DNA, 490 bp, Eucalyptus grandis
gaattttcgcttcaccatctccctcgccctcttcctcttcctcaattttctcagcaattccagtcgtactacagaagccgcacctacttatctagagcacgactgcccgaacaccacgctcgtctctcccaactccacctaccgatccaccctcaacgccctcctctcttccctctcctccgccgccgccggcgacgccgacggtttcgccaacgctaccgctgggaaggacgcccccgaccgtgcctacgggctcttcctctgccgcggcgacgtcggcaccgccacgtgcagcgagtgcgtggctacgggaacaaaagacatcctccgatggtgccccgacaggcgatcctccgtggtctggtacgacgagtgcatgttgaggtactcggaccagtccatttactcggtgatgggagacggtaccgatatacacgatgccgggacaacggggacgtcaccgaaccaagattggtttatgcagctgcta

SEQ ID NO: 287 - DNA, 329 bp, Eucalyptus grandis
tgtgcatccaaatagggcttttgtgtacacaaggcgatccacacctccgcccaaccatgggccgggttgtggtcttgctgtcgaagaagcctggcaacctggatgagcccatcacgaggccgggcttacccggcacccgttacagacggtcccgtcggcctcatggcttgtctggttctaccggaactacttcaggaacttccagcaccgcgatgcactccttcggctcaggaatcaacacgagatctgagacgcagtcgacggccacaaccacaacgatgtctagcctcccgagtccttcagatcctcatgggaagcgtcctatgcag

SEQ ID NO: 288 - DNA, 564 bp, Eucalyptus grandis
gcttcatgttgagttgaaaaaaccccaaccccaaaaaccgaaaagccccctagccagaaaagactctgaacgaccttcaattatgccgagaccgaccccttcacctcctcatattcacatcttcttcctttcgtacatcccctgtctcgtcttcctgtgcttactctccaatgctgcagagtctcaaatccaagatcaagaacagcaagtcctgttgaagctgaggcaatcctggcgagacccatcttccctcgaccactgggtcgcctccaattcatcctcccactgcacatggcctgagatcacatgccaagaaggctcgatctccgagctcaatcttgtcaacctgaacataaattattcgatccccccaatcaaccgccaacccaaaaagccgaaccaagctcgacatctcctacaacaatattcctggagggtttcccactgttctctacaactgttccaagctcgtgtacctcgacctgtcccagaattactttgaaggtcctatcccatccgatatcaatcgcatggccaatcttcaggtcctgattcttgctgcca

SEQ ID NO: 289 - DNA, 591 bp, Eucalyptus grandis
gaaagttagagagttagagagagagagagccagcatgttctctctcttcttcctcctcctcctccctctcctctccgcctccgctcccgttccgcacccctacggcaacgtctcgtaccacatcgactgcggcggcaactcccccgtcgtcgactccttcaacaccacgtggctccccgaccgctacttcacggggggcgccgccgccgtcgtctcggagcccctccgcttccggcagccccaggagaagacgctccgctacttccccctctcctccggcaagaagaactgctacgtcctccccggcctcccctccggccgctactacctccgcaccttcaccgtctacgacaactacgacggcaagtcccaccccccgagcttcgacgcctccgtcgagggcaccctcgtcttcagctggcgctccccctggccctcccccgacctcgccggcggcagcggcgcctactccgacctcttcgccttcgtccgcgacggcgaggccgacgtctgcttctacagcatggccaccgacccccccgtgatcggatccctgtcgctcgtccaggtcgatccgctgtcttacgattc

SEQ ID NO: 290 - DNA, 641 bp, Eucalyptus grandis
gcacgaaatttctcttattcccctaaccatgcagcatcatgcatgatcaactttgctttcacaggattagtttattcatgccacgaagactcgaagagagacttcgattctcgccttttcaccggacacttgcgctgccctccgcctttccctgctattaataatagggtggttcctcgtccctattcgattctagcctctcctcttcgtcgtacgaaactcccaggcggcaccacggcgctcgtccgtcgtcgagcagcggcggagcacgagaagaagatggcggcgacggcggcgaaaccgccctgcaagcccgcttcctacttctgcttctcctcctccttctgcctcctcctcttcgtctcggcttccctcgcgcagagcgacctcgacgtgctcctgcagctcagggccgccctggccgcgcccaactcgaccgccctccacgactgggtcggcccctcctcctcctcctcatcctcctcgtcgccgccgccctttccgcattgctccttcaccggggtcacgtgcgacgccggctcccgggtcgtgtctctcaacctcactgacgtccgcctcttcggccgcgtccccgcgaaatcggcctcctccgcgacctcgtcaacctcacgctcaccagc

SEQ ID NO: 291 - DNA, 2884 bp, Eucalyptus grandis
tccaacctccttttcaaactgcaccagcctccacacattgagtttagcaaataacatgttcactggagagattccccactcatttgggcgacttgctagtttgcaaaaactcgacctctctcacaaccatcttacggggtggattcctgatgagctgggaactgcatgcaactcgctaatcgagctcacgctttcctttaacaacatctcggggccaattccattgtctttctcatcatgttcatggttgcagagcattgatttgtctaccaacaacatatcaggcccctttccagattctatccttcggaatcttggttccctggagagtttgctactgagcaacaacaccatctcagggctatttccagcttccctctcatattgcaaaaagctgagaatcatagatttcagttccaaccagttttcaggtatcataccacctgatttatgtcttggagctgccttgcttgaggagctaagagctccagacaatctcatcactggaaatatcccacctcaattatctcaatgctcacaactcaagaagattgatttcagcttgaactatctagttggctcaattccagcagagattgggatgcttgagaatctggagcagctaatcgcatggttcaatggcctggaaggcgaaatcccaccagaattaggaaaatgtaggaacttgaagaatctcatccttaacaataatcatcttaagggtgaaattccaacagagctgttcaactgcagcaatcttgaatggatatcgctcacaagcaatgaactgactggtgaagtcccacgtgaggtcatgcttttgtcaagattggctgtactgcagctggggaataacagtttgagcggccagattccatgggagctgggaaattgcagtagcttgatgtggttagacttgagcagcaacaaattaacaggagaaataccgccgcgactggggaggcagcttggagcaaaaggaccggctggtattccttctggaaacacccttgtgttcgtaagaaatgtgggcaatacttgcaaaggtgtgggaggtctgttggaattcgccgggattagacctgaaaggttgttgcaagtgccgtcattgagaacttgtaacttcgcaagaatgtactcaggtccaatccttagcaagttcacaacataccagacagtggaatacttggacctttctgacaaccagctccgagggaagatcccagaagagtttggggacatggtagctctgcaggttctcgagttatcatacaatcagctatctggagaaatcccttcatcgcttggcagactaaaggatttaggggtgttcgaagcatcacacaatcgactgcaaggccaaattccagattccttctcaaacttatctttcctggtccagatagatctctcctacaatgatttgacagggcaaatcccacagagagggcaactaagtacacttcctgctagccagtacgaacacaatccaggactttgtggggttccgttacccgaatgtcggaataacgaaccagaaacaaacccagacgtggccatgggcacgaaaggaagagcaaagccagggactgcatcatgggctaatagcatcgtcctcggaattctactttccattgcttccatctgtattttgactgtatgggggatagcaatgcgttcaagaagaaaagaggcagaggaaatgaagatgctgaaaagcttacaagcagcacatgcaaccacaacgtggaaaattgacaaggagaaagagccactgagcatcaatgtcgcaaccttccagaggcagctgaggaagctgaaattctcccagctaatcgaagccactaatggcttctcagcagaaagcctcatcggttgcggtgggttcggcgaagtgttcaaggctacattgaaagatggctcaaatgttgcgataaaaaaactcataagattgagttaccagggcgacagagaattcatggctgagatggagacattggggaaaatcaatcacaaaaatctagtgcctctgttgggttactgcaaggtgggagaggagaggctattagtatacgagtttatggaatacggtagccttgaagagatgctccatgggagagtcaaaactcaagatcggagaatacttacatgggaggaaaggaaaaagatagcgcgaggggcagcgaaaggactgtgtttcctccaccataactgcatcccccacatcatacaccgggacatgaaatcaagcaatgtattgctggaccatgatatggaagcaagagtttctgatttcggaatggcccggcttataagtgctctcgacacgcatctaagtgtaagcacgctagccggtacaccaggttatgtcccaccggagtactaccaaagcttccgatgcacagcaaaaggggatgtgtattccttgggcgtcgttctcttggaactattgaccggaaagcgccctaccgacaaggaggattttggggacaccaacttggtggggtgggtgaagatgaaggtgagagaagggaagcagatggaagtcatagacccggccatgctatcgacaaccaaagtgcaggaggaagcggaagcagaagcagaagcagaagtagtgaaggagatggtgagatacatggagataacgctgcagtgtgtggatgatttcccttccaggaggccaaccatgttgcaggtagtggccatgttgagagagcttgtgcctggctccacaaccgtaagcagcaacagcacctgaaacatcatgaactgttaatgtttctctttcttattgtttatggtaagaagatagcgcctgtatgttttattcatatgttaagaattaagataagatcttttatgtaaaaaaaaaaaaaaaaaa

SEQ ID NO: 292 - DNA, 1100 bp, Eucalyptus grandis
gagagagaactagtctcgaattttctcttttttttcttcttttggctttacagacctgaaaattgggcaaagaaaaggaaaggctggaatagcacgtgagaggcacgtggctgtgggctggttaaaacgacacgctttgggaacaacgcacagacatccgcctcattccggcgcaaggaaaaaacattaaaaagccaggtttttaatgtttttctaactctgtttcgttcttgatttcttaccatgaaaagttcaccgacgtggcggcggtggtggacgcggtttcttctcttcctctccaaagcttagcttgcacctgcggagactctcccctcccttcttcactttgagctccttctcttcacgttcctttccggtccgcaggcactctcacgccagccgaagttggctcgaggggggactacgaggaaagatggatggcgggtcgagaatgaatagagccaagctccgagtcgcggtgttgatggcggttttcttagtctgcgtcgaaaatctgagcttctgttggtctctcaacggcgaaggtgtagcgttattaagatttcgcgagggagtggagagagatccttatggggctttatcgaattggaaggacgatgtcggagttgtggatccctgttcgtggtttggtgtggagtgctcggacggacaagtaccgacaaggaacgggcaggaacttgaaagatcttggtcttgagggaatgctaactcctgaactggggaagctgactcatgtaaaatccattattctacgcaataattctttctggggaaacatccctggggagattgcaaaactgaaggagctggaagtgttggacttgggatataacaattttagcgggtcttttccatctgagcttggcaataatctgtccctcacaaccctattacttgacaacaatgagttcatgggttttatctctcctgaaattgatgagctgaagacaatctctgaatcgcagatgcatgaaaggcaagaaagtagtcttgccatgggagcggactctaatagcatgactaatatccggaatggtgttcatcctcaaactgcaacttacaggaggcagatactggca

SEQ ID NO: 293 - DNA, 424 bp, Eucalyptus grandis
agcgtacatacacgagcacagtccccggaagtacgtccatgggaacctgaaatccacgaaaatcctccttgatgatgagtttcagcctcacatatccggattcggtctcaatcgtcttatctcagggactccgggattcaccgcctcatcgtccaagaagcatggctctaataaccaaaccgtcttaagctccgcaatggagctgaagatgccggctccctcggtcgctaacttggcgcccgagacccgggtatcgagcaccaaggtcacccagaagagcgatgtgtactcctttggcatcgtcctgatggagatcctcacggggcaggtgccggacgcagggcccgacaacgacgggaagggcctggagaacctggtgaggaaagtgttccgggaggagcgacccttgtccgacattatagac

SEQ ID NO: 294 - DNA, 466 bp, Eucalyptus grandis
aattattggaaaaaagatgccactattaagactagtgtcactttatggaaataacctcagcggtgatgttccaaattcgttgtgcatgttggatgaattgtcttttcttgatgtctccaagaaccaattattaaggagacttccgcaatgttggaggaactctcaagcaaatttggagtggatttcatcgggagataacaagttaaatggtcagattccatactctctatgccatttgaagcaattaggagttctaggcctacgtaaaaatggtttgaacggagtgtttccaaaatgtttactaaagttagatttggtagaccttgatctcagtgacaatcaattcaccggtagaatacctccatttggacaacatgctcaattgtttaaaacaatcgatcttcagagaaatcattttatagggaacattcctttacaactatgccatcttgttaatctccagtat

SEQ ID NO: 295 - DNA, 516 bp, Eucalyptus grandis
catagctggtgcagcaattgctgtgtccgtcttcggcgtaactgttactggttctgtctcggtcaagatgaagttgagactcaaaaagttcaactttgaacaaaatggaggagaaatcttgaaacaacgcaaagtcaaaatcttcacggaggtggagctggcaaaagcaaccaacgactataatgacagtaataagctcagcgacgaccattctagttctgtttataaagggacaatagcaagggacaccatggtcgtggtcaagaagcctcaagatgagcacaagtctataataaggcggcatttcaaaggtgagcatttcgaagatgagcatttcgaagatgaacttgaatttctgatgagaagaagccacaaaaatatggtgaagctcaaaggcatatgtttggagactgaaataccattgctggtatatgaatacattccaaatgacaccctcttcgaactcatccaacagaatgagttgacatgggaacaacgcttcaaaatagctgctga

SEQ ID NO: 296 - DNA, 786 bp, Eucalyptus grandis
gaagcacaaaggtcccaaaacggacaaaaattacgtgagagagagtttaagagagtttttttcgaaatgaagatagggcattggcttctaacggtggctgtggcctggtggtttcaacaaggcagcgccgccgtgcgcagagactgcacacgccagtgtgggggcgtgcccgtaccttatccattcgggctcgaacccaattgttcgaggtccacagattttttgctcgattgcaccaacatcggagggagcggttttcgactaatgttgggagatcttacgatactcaaaatctcggtaggggactcgaccatggtcgtcagcctccccgaagcatacgagtgctacgatcagaatcgcagcctagcaaacagaaacgtgtccatcaatctacctccaaatcctcggtacagattctcagaaacccagaacaagctcatcgtcgtcggctgcaacgcccttgcggacatggccaataaagaagggacggtcaggaaaggttgcgcctcctactgcagcagcaatgtcgacctcgccaaggagaccacttgctccggtcaagtttgctgtcaagcatccataccagcggggctcacgacgctcaacatttccctctcctccatcggccaaaacgtgtcgaactcggaacgcgggcactgtgcacgggccttcatggtggacaacaggccattcaatatcttaaacttgactctcccgacgttccaagatgtgggtaacaactcgagccttgttctggactggatggtccaatccgacgagatatgc

SEQ ID NO: 297 - DNA, 969 bp, Eucalyptus grandis
ctccctcctctccctcaaatcctccctcagagatcctcactctaccttccatgactgggaccccacgccaaccttctccaaccctactctccagaaccccgcatggtgttcctggtctggcgtcaaatgcaacccacaaacatcccaaatcacttctctcaacctctctcgccgcaacctctccggtgcaattccggcggaaatccggtacttgacgagcttactgcacttgaatctgagtgggaatgcctttgatgggattctccagccagccatttttgaattgactgagctcaagacgcttgacatcaaccacaacaacttcaactcaacattcccaatgggcatatcaaagcttaaactcctgagagcctttaatgcctacagcaacagcttcacgggtcccctccctcaagaattagtaagtcttcagtatctcgagtatctgaatttgggtggaagctacttcgaaggagagattccctccgactacggcaactttccgcgacttaagtctctgttcttgcatgggaacgttttagaaggtcccataccacccgaattaggatcattggcacagcttgagcgcttggaaatcggatacaatcaatattacggcggtatcccgagtgaacttgcgcttttatcgaatctcaggtacttggacatctcagctgccaacctttccggttcgcttccgcaagagctcggtaacgtgacaaagctggagactttattcctctttggcaaccggttgaccggccaaatctcgcggagtttctcgagcttggaagcgctccaagctctcgacttgtccgacaatcaactgtcgagggacgatacccgaagggctggggtcgttgaaacagctcgccaccttgggtttgatgaaaaacaacctcagcggggaagtaccacaaacacttggcgtgcttccactgctggagacgctccagctctggaacaact

SEQ ID NO: 298 - DNA, 848 bp, Eucalyptus grandis
gagagagagagagagagagagagagagagagactgagagggtttttcggaaatgaaggtagtgcagcagcttctactggtggctgtggtggttgcgacaaggtggtgctcccaccgtggccggacactgtgcacataggtgtgggagagtgcccataccttatcccttcgggctcgaaccccaatgtgcgaggtccaaagagtttttgctccattgcaatacttccgaagggagcggtgatcaactattgttggggaatattccgatacgcaagatctcagtcggtgactcgaccatggttgtcagtctccccgaactacacgaatgctacaataagactggccagctagtaagcagaagcgataatctgtccatcgatctatcttcatatccacagtacaaattctcggccacccggaacgccctcacagtcctcggttgtgacacctacgcgctcacgaaggtgctcgcggccgacaaagatgatttttcccggggcggctgcatctcctactgcagcaagtacgttgacttggcgaaggagaccacctgctctggtatcggttgctgtcaagcatccattccgaaggggctcaacacgctccaggttagaatctcctccttcaacgatcacgtgaatgtctcgtcattcagcccctgtggagtggccttcgtgggggacaaagagtcattcaatatctccagcaagagactcccaaccttcgatgatttggacaagaagtcggaccttgttctggactggatgatcggatggaacgtcaattgcgcacaggcgacatcgaaccagtcgagctatgcctgtggcaacaacactgactgcgacaact

SEQ ID NO: 299 - DNA, 537 bp, Eucalyptus grandis
gttccaaaaaggagagagagagagagagagagagagagagagagagagagtttttcggaaatgaaggtagtgcagcagcttctactggtggctgtggcctggtggttgcgacaaggcggtgctcccaccgtggccggaaactgtgcacataggtgtgggagagtgcccataccttatcccttcgggctcgaaccccagtgtgcgaggtcgaaagagtttttgctctactgcaataccaccgatgggagcggtggtcaactattgttggggaatattccgatacgcaagatctcagtcggcgactcgaccatgcttgtcagcctccccgaactacacgaatgctacaacaagactggccagctagtaagcagcaccgataatctgtacatcaatctaacttcatatccaccgtacagagtgtcagccacccggaacaacctcacagtcctcgggtgtgacacctacgtgctcatgaccgacagatatgggcttttccggagcggctgcatctcctactgcagcgagtacgtcgacttg

SEQ ID NO: 300 - DNA, 328 bp, Eucalyptus grandis
aaggggagagagagagtctgagagagttttttggaaatgaagatagtgcggcatcttctactggtggccgtagcctggtggttgcaacaaggcggcgcttccaccgtggccggacattgtacacgcaggtgtgggagtgttgccataccttatcccttcgggctcgaaccccagtgcgcgagtaccgagcacaccaaagagtttttgctctattgcaataagaccgaagggataggtggtcgactactgttggggaattatacgatacgcaagatctcagtcagcgactcgaccatggtcatcagcctccccgaactatacgactgtt

SEQ ID NO: 301 - DNA, 800 bp, Eucalyptus grandis
gagacagagcgtaaggaaaccagttgatccgtccaccatgcgctcttccgttccctccctcttcctcctcttcctctgcttcgcccatggcaccgccgaccccactgacaacggcccttgccccccccagaggtgccgccgccatcacgggccgttggtccagttcccgttcctgctcgaacgcaagggccaacatgacgactgcggctacagtcgggacttccacttgtcctgcgaccagagcgggaacaccctgctctcgctcccggggaccccgcggccacttgtcgtcacggacatcgattacgagggcagttccatcagcgtgcgggaccgcgacggctgcatccccttgccgctggcgaacctcaaccactctatcttctcctacgagaagagccaacccagccagtatagtagttaccagccgccctacaactataccctgttccagtgtccgcgggacgggaggagcgagggccgcatgacccggctggattgccagagcacatctgcgtatgacgtcttcgccgtcgagtcctactcctacgtgggagacttgccgctggtgtcctgcatgaggaacgggagcatcgacttgctcccgaagatgattagtatgatgggcgaggttaatttggtctgggaaaagccggactgcaggctatgcacgaagaacgggtcgttgtgtcgggggaacgagaacggcatccgctgcatcaatcctcctggcggatacaaagaaagaagaaagctagagatcgcgggaggagtggtgggtttttttctctttcttggtg

SEQ ID NO: 302 - DNA, 527 bp, Pinus radiata
ggatgatagcattgaggcttctcagggatagttgcatcaggaagcctgacgagttcctggagacaattaaggaattggggtccattaggtacaaccatcttgttgctatcctggccttttattccggttctatgggggagaaattgctggtttatgagtatataccaagaggaaatctggcggagcttctgcataatgcaaacagaccagcacctggttgggctaaactgcatagaattgcactaggtgctgcaaggggtctagcataccttcacacttgcctggaaacgcctatcatacatggcaatctcaagtccaagaacatactcatagatgataattatgaggcccatctttctgactttggtcttcacttacttatgaatccgagtacaaaactggcgatgctagaagcttctgcttctcaaggttataaagcacctgaactgctcaagatgaacaaggcaaacacaaaaacagatatttatagttttggtattatattacttgaaattctcaccggcaga

SEQ ID NO: 303 - DNA, 296 bp, Pinus radiata
aatcgctgcaagtacttgacgtcggctcgaatgttctcatcagcgggtctattccagtagaattgggcctgttgcacaaactccgcgtcctcgatctttctgtaaactatctggaaggaggaattccaccacagatgggccatcttaaagcgttgcgagttcttgacgtcagttacaatgtactcaatggttctattccggctgacttgggcctgctgcagaaactacagcacctgcttctgggaggcaacaaattttcaggcagtgtaccacatcagttaggtcaaaccaattcg

SEQ ID NO: 304 - DNA, 408 bp, Pinus radiata
cagagatacaaaaagccaccaacaactttgatgaaaatttgatacttggcgtgggaggtttcggtaaggtctataaaggcgaactggaagatgggaccaaagttgcagttaaacgaggtaatcccagatcagagcaaggtctcacggaattccaaacagaaattgagatgctgtctaaacttcgacaccgccatcttgtttctctgattggatactgcgaggaacgctgtgaaatgattctggtctatgaataccatggccaatgggcctctgaggagctcatttgtatgggtcagatctttcacctctgtcctggaaacagaggccttcgaaatatgtataggggcggcaagaggcctccattaccttcatactggggcagcacaggggttttccaccgtgatgtga

SEQ ID NO: 305 - DNA, 551 bp, Pinus radiata
gctacgcagaattttgaggatcaaaacaagattggagagggcggattcggtcctgtttacaaggggatccttgccgatggaagagaaattgcagtgaaaaagctgtctgtaaaatcgaagcaaggcaaaactgaattcatgaatgaagtgaagattgtggccaaaattcaacacaggaatcttgtgaaattattaggctgttgtgctgcgggaatggaaaagctgcttgtttatgagtacatgccgaacaacagccttgacaagatactctttgatccagaaagatgcagaatccttgattggcagaagcgttataacatcattcttggagtagctcgcgggcttctttaccttcacgaggattctcagcctcgaatcatccatcgagatattaaggcgggaaacattttgctggctcagaccctaaatcccaaaatttcagatttcggcatggcgaggcttatccgagaaaataacactcaactaaagacgagaattgctggcacatacggctatatggctccagagtatgcaatgatgggcacttatca

SEQ ID NO: 306 - DNA, 320 bp, Pinus radiata
ggagacaagcacttggtcacatggttccggcgtatgctcatgagccgcgagggtttccgcaaggctattgacccagtccttgacgtgactgacgataccttccaaaatatctgcacagtggcggagctggctggtcactgcacctctcgggagcccttccagcgccctgacatgggccacgcagtcaatgtgctctcccccctcgtcgagcagtggaagcctgccaaaacggattccgaggactgctacggtattgaccttgatgtgcccctctcccaggcgctcaagcgatggcaggccgttgaaggaggggtaccatc

SEQ ID NO: 307 - DNA, 609 bp, Pinus radiata
aatggagaaactgtggccatcaagaggctgtggaacaatggaaatgctgaaggctctacatcctgcaatgataatggattcaaggcagaagttgaaactttgggaaatattaggcataaaaacatagtgaaactctggtgttgctgtgtcaatgacgattctaatcttttggtatacgagtacatgcctaatggcagtttgggggatctccttcatggccccaaagctggtgaccttaattggcctacacgttacaaaattgcagttggagcagctcagggtttggcttatttgcatcatgattgtgtacctcctatcatccatcgcgatgtgaagtccaacaatattctgctagatgctgattttggtgctcgtgtggctgattttggacttgccaaggtccttcagagctatgagaagggaatcgattcaaggccgcaaatgccggaacccaagggtaaaaaaccccaaaaaaagcaaaaaaccccaaagggaaagaaaaaaaggaaaaccaaaagtttggaagggggcctccaaaaccaaggaacggcaaacaacccggaaatcaagaatttgaagaaaagaaaaaacgttgtaatgtgggtgcgc

SEQ ID NO: 308 - DNA, 550 bp, Pinus radiata
aacccacgtattattcacagagatgttaaaacttccaacattctcttagatgacaattttgaagcacatttgtcagactttggcattgccaagtgtatcccttctgccaaaacccacacctctacctatgttatgggtactattggttatattgaccctgaatatgcaaggccgtctaggcttaacgagaagtctgatgtgtacagctacggcattgttcttttagagctcctcacagggaggaaagctgtggataacgactctaatttgcttcagctgattctatcaaaagcagacaacaatacagtaatggaaactgtagaccaagaagtaggtgtaacctgcacagatcttggggttgtaagaaagatcttccagctggcactgctatgcacaaagagacagccttctgaccgccccaccatgcatgaggttaccagagttttacagtcattagtaccagcttctaaacaagctccaggtatcagagtaaaccaaccagcccccagcaacaactacagaagatatttggatgagtatgtggaaggca

SEQ ID NO: 309 - DNA, 1145 bp, Pinus radiata
cttgcaatccatggacctttcaaacaatctgctggaaggagaaatcccggaagagttctcccagctaaaggagctagccctcgtgaatctcttcagaaataggcttcatggaagcattccttccttcatcggtgaccttcccaaccttgaagttttgcatatatggggaaataacttaactggcgggattccccaacagctgggaaggaactctaagcttttggaggtggatctgtcttccaacaagcttactggcttcattcctccggatctctgcattggcgggaagttgcagatattgattttgcttgagaactttttctttggccccattcctgaatctctgggtaactgtgagtcgctcactagagtccgaatgggcaacaattacctgaatggatccatcccaaaagggctgctataccttccgaaattggggatgtttgaagtccatgacaactatctaagtggcagcataccacctaaaagtacggtgacctctagcttgggtcacttgagcttgtctaacaacaggctcactggtccacttccggactccataggaaagttttccaacttgcagatccttctacttgatggcaatcagttcaccggcagtattcctccagagattggccatttgaaggagttgtccaagatggatttcagcggtaacagattttctggagcaatacctcctgagataagttactgtaagcacctggccttcatagatttgagtaggaatgagctcagtggacccatatccccacaaataacgaagatgaggattctcaattatctcaatatctctagaaaccatttggtaggaagcattcccagagagattgcaggcatgctaagcctaacatctgtggatttctcctacaacaatctctcaggtttagttcctggtactggccagttctcctacttcaatgcaacttcctttgctgggaatcctgagctctgtggaccatacttgggaccttgcactgccgtatcttcatccaaggaagcccatatcaaagggccattttcttcaactttcaagctgcttttggtcgtagggcttctcatttgctccatggcctttgcaattgctgctgttattaaagccagggctctgaaaaaggcaaacacta

SEQ ID NO: 310 - DNA, 318 bp, Pinus radiata
aagagtacgagcctagaataacagattttggattggcaaggttgatgaatccagtagatactcatcttagcactttcataaacggtgactttggagatctgggctatgtagcacctgaatacatgcgcaccttggtggctactttgaaaggagatgtgtacagctttggagtggttcttctagaattaattacaggacagaagcctatcaatgttgaaaatgtagagaatagcttcaagggtaatctagtagattggattactcaactttcaaacgatgcccgcatcgaggaagctattgataaatctttgataggca

SEQ ID NO: 311 - DNA, 464 bp, Pinus radiata
gttacagtaccaaaggatttcatatcaagaacttcacactgcaactaatggatttgctgaggccaacctattaggaacagggagttttggatcagtgtataaaggagttttgaatgatggcacagtggtcgctgtgaaagttctccaattgcaaaatgaccaagctgagaaaagttttaaggcagagtgtagtgtcttgcaaaaggttcgacatcgaaatctagtgagaatcattacttcatgttccaacctccagttcaaaggtttagtgttcaaatttatgtctaatggaagcttagaaaagcatttgtatcccaataaggatgacaataatagtgaggatgtatgtgaattgggattaaaaatgcgattagacattgccatagatgtagcccaggccatgaaatatcttcatcatgattcatttgtgcaagtaatgcattgtgatataaaacccaacaatg

SEQ ID NO: 312 - DNA, 293 bp, Pinus radiata
actctggggaatctgacggagctgaaagtattgagtctaaggcaaaacaggcttagtgggtcattgcctccagattttgtaaacctgaagcttctaggtaacctctacctgcaaaaaaacatgttttctgggccgctgccttcgagcctgtcttctttggtcggattgaatgtgctggatctctccttcaatcattttaatggtaccattcctgtgtttctcaacaatcttaagagtcttacaagtctggatttgcaaaacaattcgcttacaggcaatatatctaatctgaa

SEQ ID NO: 313 - DNA, 503 bp, Pinus radiata
tcacatccctgtagaatttgccaatttgaccaaattgacgtggttatatctctcaagcaatgatctcactgacatccctaaatgcattgccaagttgaccaaattgacctctttatctttctctttcaatagactcgctaacaatatccctgaagctattttcaatttgactaagttagaaatgctagatctttcttcaaacatgcttattggtgacattcctataactcttaccaatttaaagaatcttaaaatccttgacctctcaaataacaattggaaaggcacaattccaagagccataggaaaacttcatttgttggaaagcttaatgttacaatcaaacaagttaactgggcatatcccatatagtataggtcaattaaaagctttgtatacactaaacctatataataacagtatctcaagtagtattcctgagagtataatggttgattcattatacacattagatttatcagaaacacttggagggccaatcc

SEQ ID NO: 314 - DNA, 539 bp, Pinus radiata
gcctccctcgccttcccctctttcccatgatatggtatcccattctttgaggaaaggagcaatggcagcaattgtgtccgtagctgcagttacagtggctgccatggtattcttcttactttgcttgtatagaagacgaaaagcccaagctatgaagaaatgggttgtcccaaagcctccatttatgtggaaaactgacagatccgtaactgaatcggggccattctcgttcgagacagattctggtacatgggttgctgacatcaaggattcaacctcggcttcagtaatcatttttgaaaaacctctgctagacctcaccttctctgatctcctagccttaacttcccatttcagcaaagaatcccagctggctgaaggacaaaatggtcccgtttatagagccatattaccgggagatatccatgtagctatcaaggtattagagggagcaaaggatctaaatgcagaggaagctgtgtcaaagttagaggcattgggtcgtctgaagcatccaaacattttgcctcttctgggtt

SEQ ID NO: 315 - DNA, 683 bp, Pinus radiata
cattgcagggcttagtaagcttaccaggcttgacttatcccaaaatatgttgtcaggacccctgacactgtcgttggggaagctggggagcttgcaggttttgtccatttcagggaatatggtaagtgggtctgtgcctggttctctcaataacttgaagaatttgatgaggttggatctgtcacacaatcgtttgagcggtgtgattcctccattgggtgggatgatcaatcttgataatttggatttgagctttaatgggcttgtgggtggtattccctctcagctgccacggtctctgtctcagctgactctgaaatcaaatctcttgcgtgggaacctacctccgagcttgagcagtttaagtgagttgggtgttctggatgcgagcattaataggctgagtggtgccattgatgggtctctgtttgctcatccttctctgcagcagctgaatttgtcaaataatagcttaagtgcaatcagtgtgctgaaaggaacaggaaagaacagccaaattgtggctgttgatattgggttcaatagaataacggggtcccttccccctaatttctcaacattggactccttggcttcactcactctgagatacaatcagtttcagggatcaattcctgtagagtatggtgttaaggctatgaattcttctagacctctggcta

SEQ ID NO: 316 - DNA, 358 bp, Pinus radiata
gcagattgcaatggcctgtgttggtaggatgcctgatcagaggcctaaaataacagaagtagttagaatgattgaggaagtcaaacaatttgattccaggccatcctctgaagacaaatctaaagactccaatggccatactccttcacatcaacgaacaccaccatctggagtgcacactcccagtgcaactaccccataaaattcattttcctttctgttgcattcttcagtgcataaagtattttcatgtagcagtgcagccccttctttctgtaaggattgctctctctgtttgtacaagtagaaaagttttccaaacatatccattggagccttcctagtatcagcacttttt

SEQ ID NO: 317 - DNA, 647 bp, Pinus radiata
gctgaacataactgttttgcccattctgattttgctgaagcaccaaggcttcataagagcaaaatggaagtacggatgataaccataatgatattatgtgctgctttactatgtgaagggagcggagaggtggatgttctgatggagatgaaagctgcattggaccccaagggggagatactctactcttgggtgaagggaggagatccctgcagtgggacttttgatggagtggcctgcaatgagcaaggaaaagtggctaatgtttctctgcaagggaaaggattatcaggctcaataccctcaaccattggcaagctcaagtgtctcactggactttatttgcattacaacagccttggaggggagatacccagagagctttctaacttaactgagctgctggacctttatcttaatgtcaatgggctctctggtcccattcctaaggagctgggagccatgtccagcttgcaagcactccagctgtgctgcaacaagttgacagggcctatacctatggagttgggatctctgaagaagctcaatgttcttgccctgcaaaacaaccatttaaacggtgcaataccagcatcattgggagtgctaacctcgctgacaaggctggacctcagcttcaactcact

SEQ ID NO: 318 - DNA, 695 bp, Pinus radiata
ttcttcttgatcaacacttaaatcctcttctttcagattgtggtctgcataaactattagcggatgacattgtgtattcaatcctgaaatcttctgcaggcatgggatatttggccccagaatacaccacagttggtcgtcttacagagaaaagtgatgtgtatgcttttggaatcatactgctacagcttctcactggagaaacaaggataaactcttcttcaataaggtctcttgtacaatctgggagaccggatgaattcattgatataactctcggaaaggagtactcaaaagaagaggcttctaatttagcacgcattgcattggactgcaccaatgaggttgctgctcaaaggcctcctatcagtgttgtactgcagaaactcgcttggattgatgacaaggaacaatgatgcctacttcaattcacttgatcaggcatggcaattttagaatgtggattcatccaaacatctctgtttggtcttttggttaaagatccatatccacgtgtataagtttttgcattacttgaaacattcattaacactcggggatctttcaaatccttcgatccggaattcaaataccttttttttcttcctgtatagattatacagatgtcaacatttaaccaagaaaacaaattaaccatttcgaaagtggatttcagttaaaaaaaaaaaaaaaaa

SEQ ID NO: 319 - DNA, 533 bp, Pinus radiata
tgtcgagccaccgggcagcatggtgatatcgatccaggtactccgcgaggtgaccgacaatttcagcgagggaaacatattggggcgaggtgggttcggggtggtatacaagggggagctgcacgacggaaccaagattgctgtgaagcggatggaggcagcgaaggtgagtagcaaggggctgagcgagttccaggcagagatcgccgtccttaccaaggttagacatcggcacctcgtgggtctcctcgggtactgtatcgacggtggggagaagatgctggtgtacgagtatatgccccaggggccgctgagtctgcatctgtttgaatgggcggcggccgggctgaggccgctagaatggaaacagaggcttagcattgccctcgatgtcgcccgcggagttgagtacctgcacagccttgcacagacgagcttcattcacagagatctgaagcctctaatatccttctgggcgacgacatgagggccaaggtctcggatttcgggttggtcaagctggcccctgatgg

SEQ ID NO: 320 - DNA, 430 bp, Pinus radiata
attgaacgaggaaaatacatagttcgtgaagttaaaagcgccttagaagcgggtggaattggtacgctagttagcgaactagttgatcccctgctactaggatcagactcacacggtactcttcttccaggccttgaaagctttgtgaatctcgcattgaagtgcgccgaggaatctgctgcagatcgaccgagcatgagtgatgtagtgaaggagctggaatcgattgccaccaactgcaaggatgacgatgggccatacaacaactcatctgcatcatctctcgccagtgattccggtgccatcaacattaaaggcttttattatactcagtctagtaattatacttcagacgatggcattctcaagaagggtggatcctttgagtacagtggcggatattcagtgcgtcacaccgtggagcccaagt

SEQ ID NO: 321 - DNA, 489 bp, Pinus radiata
tagagtttgggttagttgtggcagtgaagcggttgaaggatgttgtaattgggcagaaagaatttgttcaacagattgaacaagttggaaaaatgcaacatgaaaatctggtacctctcagagcttattacttttcgaaggatgaaaagcttctcgtatatgattatatgacaatgggcagtctctcttcccttctgcatggtaacaggggagcaggtcgaactccgttagactgggaaacacgctctcgtattgcccttggtgcagctagaggcatcgagtatctacatagtagaggcagagaaatttctcatggaaacatcaagtcttccaacattcttctcaccagggactataatgccggtgtttcagattttgggcttgctcagttagtgagttcaactccatctgccaatagaattgtcggatatagagctccagaagtcaccgatgctcgcaaaatttcacagaaggctgatgtttccagct

SEQ ID NO: 322 - DNA, 234 bp, Pinus radiata
ctgaaaacgaacaagggcaggtactaagagtggtgctcatcgcttttctttgcgttcagggattgtcaagtcagaggccatccatgtccatggttctgaatatgcttacaggtgactctgacatcttagttacgccctctgcacctgctttaatcgactctgagcatataagcgtatcttccgtggccagagctcaaacgctccatgtttcaacccctccgtcaacatcccatg

SEQ ID NO: 323 - DNA, 1134 bp, Pinus radiata
gggcccccctcgaggtcgacggtatcgataagcttgatatcgaattcggcacgacatttctgacaccaatactgaggcctctgacttttcacatgtatccgcatcccgagatcaggtggatggcacggtgaggaaaaagtccggcaggttatcgtctgcagccagaggatttgtgggtgcctgtggaacatgtattgctccgtctatcaaggaagaagaagatgattatcaatacaaggagatatcaatgacttcaacagccacagatcgaagcagggccctgagtgtggcctcacgcaagagtaacgtctatggcaatacctttaacgcaaatagtaaacctggaacaatgacctttaccatgtccgggctcagcaaagccacaggaaacttcagtccttctaacaagattggacaaggaggttttgggacagtttataaagggaaactcaaggatggaaccctggttgcaattaagcgtgcaaaaaagaatatctatgacaaacatctttctgtggaattccaaagtgagatccgaacattgtcaagtgtggaacacctcaatctggtcagatttcttggctacttggaagatgaacaggaacggatacttgttgtcgagtatgtgccaaatggaactcttcgggagcatttagactgtgtacacgggattgtattggacttagctacaagactggatattgccatcgatgttgcccatgcagtgacttatcttcacatgtatacagatcggccaatcatccacagagatattaaatcctccaacattttactcactgaaaatttcagggccaaagtagcggactttggtttttccaggcttgctccagaagatattggcgcaactcatatttctacacaagtcaaaggaacagcaggttatttagatccggagtatctaaaaacctaccaacttacaaccaaaagtgatgtttattcatttggtgtcttgctggttgagatgataactggaaggcggccaatagagcatagaagggagctcagagagcggatcactgtaagatgggctctgaagaaattcctggaaggagacgcgattttggcgttggatccaccaggctgcaggaattcgatatcaagcttatcgatacc

SEQ ID NO: 324 - DNA, 410 bp, Pinus radiata
aagaaaatgttctggggcgcgggggtttcggcaaggtttacaagggcgttctccgcagcaatggccaagaaatcgcagtgaaatgcataacgaagccattcagggagggaatgaagggtttcgttgcagagatctcgagcatgggacgcctacagcaccggaacctggttcaactccgtgggtggtgccggaggtacaagcagctgttcattgtttacgactacatgcccaacggcagcctggataaacgcatattcgggaatccggcaacggtcctgccgtggcctcagcgatacgagatcctcaagggcgtggccgcggggctgctgtatctacacgagcagtgggagaagagggttctccacagagacatcaagtccagcaacgtgctgttggattcggagctcaac

SEQ ID NO: 325 - DNA, 483 bp, Pinus radiata
gatggatccaatgtggcgatcaagaaactcatccgcctgagctgccaaggggatcgagaattcatggcagaaatggagaccctaggcaagatcaagcacaggaacctggtgcccctgttgggctactgcaaagttggggaggagaggctcttggtctatgaatatatgcaattcgggagcctggaagacatgcttcacggggaaaagggtggatttaagacccggctcacctgggaagtgagaaaacagattgccaagggagctgcaaggggtttagcattcctacaccataattgcattcctcacataattcacagggacatgaaatccagcaatgtacttcttgatagaaacatggaagccagagtttcggacttcggaatggcaaggctcatcagtgcactggacacccacttgagtgtgagcactctggctgggactcctggttatgtccctcctgaatattaccagagcttcagatgt

SEQ ID NO: 326 - DNA, 462 bp, Pinus radiata
actcttcaccagaataagatgattagggagctggagaagctggccaagctttgtcatgacaatgtgatgaggccagttggctttgtcatttacgatgatgtggctttgttattacattaccacctgccgaatggaacccttgcccagctattgcacagagaagatggtacttctgagtttgagccagactggcctaggcgtttgtcaatagcattgggagtggccgaaggattggcttttcttcatcactgccacacaccaatcatccatctggatattgcttctgccaacgtatttctggatgccaactttaatccactgataggtgaggtagagatttcaaagctgttggatccatctaaaggcactacaagcatcactgccgttgcaggttcctttggatacataccccccgagtatgcatataccatgcaagtgacagcagctggcaatgtctatagc

SEQ ID NO: 327 - DNA, 486 bp, Pinus radiata
aagcttctctgggtggggctgttgcacttgtttgtgttgctctgttagtcttttgtgttctgaggaacaggggccggtcacataaacaaactagcatatctgaaggtccaaagccgccttcccctgcgatagagaatactaaaaaaaatctcattagtggcatttcagactgcattgagaagtcattcctgtattctattgaagatctccagaaagcaactcagaatttcagcccttcgtccaatatagggggctctgtttataagggtactatagatggtaaggattatgccataaagatcatgaaaggagatatatcccaggagttaaggctattgcagaaggtcaaccacactaatctggtaaagctagaggggttctgtgtcagttctgagggtcagtcttacttggtttatgagtatgtagaaaatggttctttgagtatctggcttcatgatccagaatctgttcaggacatgaatgcct

SEQ ID NO: 328 - DNA, 362 bp, Pinus radiata
gaacttgtcatggaatttattagatggctcgttgcccatggagattagtaaaattgcaatggctcaagctatagacatttcctccaatcacttgactgggctcattccacctacacttggaagttgcagtgaactacaaacattgaatttatctagaaatgccttccaaggctctattccagattcacttggaactttactaagtcttgtgaacctagatctctctttcaactccttatcaagtccaataccaccgactctccaaaaattgaaaatgcttcagtgtttgaatctgtctttcaacaatctcacaggagaaatcccaaaagagggatttttgcaaatcaaacaatttatcatgt

SEQ ID NO: 329 - DNA, 369 bp, Pinus radiata
caggagtcggcagcaagagcgacgtttacagcttgggcatcgtgttgctggagctcgtatccgggcggcgatgcgtggacctctcagctccagcagaagactgttatcttcctgccgcaaccattcggaggtttcaggaggggaaattaatggaaatcgtggatcctcgtttggtagatgaagtcccagaagaggatgaaccgagaaaagttgtgatagtggcactttggtgcatacaagaagatcctgccaggagaccggcggccagtgctgtgagccgaatgctagaaggccacatccaaattcacgaaccacccatggcttctctgcaatctgctctttcaaggcaacgacagatctggatcactg

SEQ ID NO: 330 - DNA, 492 bp, Pinus radiata
ccttaaatggaaatgccaacctctgtggaccaaaaatattccagttatatccttgtccgacaccaaaaggtcaaggtcattctacaattgtcaaaagagtgctattgacagtgggtggagctacttcttttatactctgttgtttttttttaagattcctatggagagggaatatacatatacaaaacattcatgtttcaagatctattttccaaaagttagagcatccaaggatctcatatcaagagcttcacatagcgactaatggatttgacaaagccaacttgttgggagcaggtagctttgggtcagtttataaaggaattttgaatgatggcacacttgttgctgtgaaggttttccaattgcaaaatgaccagagtgagaagagttttaaagcagaatgcagtgtcttcgagaaggttcaacatcgaaatctagccaaaatcataacctcatgttccaacctccatttcaaagctttagtgttca

SEQ ID NO: 331 - DNA, 904 bp, Pinus radiata
aattgtcaaacaagtactattgtcaataagtggagctattgcttttatactatgttgcctacttttaagattcctatggagagggaatatgcatatacaaagcattgatgtctcaagagctattttccaaaagttaaactacccaaggatctcatatcaagagcttcacatggcaactaatggattttcccaagccaacttgctaggaacaagtagctttgggtcaatctataaaggaactttgaaagatggcacatttgtcgctgtgaaggtttaccagttgcaaaatgaccaggctgagaagagttttaaagcagaatgtagtgtcttgcaaaaagttcgacatagaaatttggtgaaaatcatatcctcatgttccaaccttcatttcaaaggtttattgttcgagtttatctctaagggaagcttagagaagcatttgtatccagatagagatgacaacaatggagaggatagttgtgaattgggattgaaagctcgattagacattgcaatagatgtgtcctatgccatgcagtatcttcatcatgattgctttgtgcaagtagtgcattgtgatttaaaacctagcaatgtacttttggatggagatatgttaggccatgtaacagattttggtatctcaagattaattggtgaaagctctactagttcgctcacttcaacactttgtttgagaggatccgtgggttatattgccccagaatatggattgggtgggatagtttccacccaaggggatgtttatagctatggaattctgttattggaaatgcttaccagaaaaagaccaactagcgacatatttgatggaaacctaaatttgcacaattgggtgaagtccacattccaaaatagattgaaggaagtgattgatagtgtc

SEQ ID NO: 332 - DNA, 363 bp, Pinus radiata
gacaggaacttggaatcccatgtagctgattttgggcttgccaagctgttggaggaccaggagtcacacatcacaaccattgttgctggaacatttggctatctggctccagaatacatgcacagtggcagagcaacagaaaaggctgatgtatatagttttggagttcttctgcttgaacttttgagtggaaagcggccaactgattcagcattcatcgagaaaggactgaatgttgttggatggttaaacctattggtcaaggagaacagaccaagggatattattgatccccaatgcgagggagtacaaatggagagctttgaggcactactttatgttgcaattcagtgtgtttctcca

SEQ ID NO: 333 - DNA, 415 bp, Pinus radiata
cagatgaaatgattgctgcaacaaaaggcttcagtacaaagatcggaaaaggaggatttggattggtgttctctggtgagttgcccgaagggaaatctattgctgtaaaagtgcgttccccctcctccgaccaaggagttgatgagttcttgaatgaggttgatcttctttctaaaatcaatcatagaaacttggtatctttgctgggatattgtaaccaatcgagccaagttaggcttatctacgagtacatgtcaggagggtcgctaatggaccacctttatggtgtgaatgcaggaaattcagaactaaattgggaaataagactcaaaatagctttggatgcagcttatggtttgcactatctgcataccggctccgttcctaagataattcacagggacatcaaaaccgc

SEQ ID NO: 334 - DNA, 330 bp, Pinus radiata
tgtctccatatcttgggaacctttccttattacgtagtttgagtttttctcataataatttgacagggagaattccaccaaactttgggaagcttaaagtgttgggaacacttgaccttagctttaataagctcgagggttctattccagttgaattggggttgctacagaagctacagaagttggctctacacttcaacaaattggagaacgccatacctccatccctgggaaactgctcttcccttatgattttaagactggggtacagcagattgtccggccatataccacctgagttgggtaatttgagggagcttagacaccttg

SEQ ID NO: 335 - DNA, 365 bp, Pinus radiata
cctggccaccctttctttcattctctttctcaatcctccttttgtcttttccacacccatcgcccatttccctcaccatcctcctcgcctcaccaatgcttccgatcaacacgctctgcttgcattcaagtctgcaatcacatatgatccctcccactccttagccacgtcttggttgccaaatgtttcgttctgcgagtggacgggtatcatatgcagcaggcgcaggcagagagtcgtttccctcaatgtttcgcacatgggattacaaggtacaatctctccctttctcgccaatctctcctttcttaggacgctcgatcttaggaataacagtttccagggtcacattccctatcaattgg

SEQ ID NO: 336 - DNA, 488 bp, Pinus radiata
gagagtcgtccaccgggacattaagcccagcaacattatgctcgacggggaattcaatgcccggctgggggatttcggcctcgcgcggctgatcgagcacgacgaaacgaatccggcggtcaccacgatgctggcagggacgcccgggtatgtggcaccagagtgcgggtacaccggcaaggctactgcagagtccgatgttttcagtttcgggatcgttgtgttggaggtagcgagcgggaggcggattgtagagcgagggccgccattatcagagggaaatttagtggactggatttggggtctttacgggcaggaaagaatcatggaggctgcggatcctagattggatggcgattttgacgaagagcagatgaaacgagtattgattttgggactggcctgctcacatccagatccccagctgcgtccttcaatcagacatgcgctgcaggttcttattaaccccaatgaacagatgaagccgc

SEQ ID NO: 337 - DNA, 421 bp, Pinus radiata
tgtatttacattcttgatcctcggcatgctcatcagaggatgcaggttgcatcgcagggattccaataaggtcaacaaccgaactttttgggagatgaaatccttccacaagctgaactttgatgagcatgaagttctggaatccatggacgaggagcacattattggtcatggtggctctggtacagtgtaccgaatacaattaagtaatggagagtctgttgctgtgaaaaaactctggacctgcaaaaatggccaccatggcggacagggcctgataaaccgagaattgaaggcagaagttgagacactgggaacgatccggcacaggaatattgtcaaactctactgctatttctcaaatggggattcaaatatgctggtgtacgagtacatgcccaatggaaatttgtgggaatcc

SEQ ID NO: 338 - DNA, 592 bp, Pinus radiata
gttcgatgcccgcggagctaggcaatctgagctcgctcgactcgctcttcctcttcttgaacgtcctgtcgggccccattcctccacagctcggcaatctgagaaacctcaagtcgttggatctttcattcaatgatctgactggacaaatcccggaagaattcaagaacctggtctcgctcacgctcctgaatctgttccataacaggctccatggcggaatacccgattccatcggcgacctgccggacctcgaggtgctgaatctctggagcaacaacgtcacgggttcgattccccgccgcctcggaagaaatggcaagctgctgaccctggatgtctcgtctgataagctcacgggcctcatacctccggatctctgcatgggtgggaagctgcagagcctcattctgctcggcaatttattcttcggccccattccggcaaccttgggttcctgcaaatctctcacacgccttcgcttgggagacaattatctcaacggttcgattcctgttgggctgttgaatctacctcagttgagcctcatcgagctccaggacaattatctgactggtcccctaatgccgga

SEQ ID NO: 339 - DNA, 527 bp, Pinus radiata
gtttacaaggctatgctgagcaatggtgaattcgtggccatcaagaggctttggagcagtggtaaaagcgatgctcccaatgaccatggtttcaaagctgaggtggacacattggggaagatcaggcataagaacatcgtgaagctatggtgttgttgtagtaatagcgactccaatctgttggtctatgagtacatgcctaatgggagcctgggagatctgcttcatgggcctaagtctagtgttcttgactggcccataagatacaagattgctcttgaagcagctcagggcttagcatatctacatcatgattgtgaaccatccattgttcacagagacgtgaaatccaataatattttgctggatgatgattatcgggcttatgttgcagattttggcgttgcgaaaattctacaaagcggtggcaacgggactgatactatgactgcaattgccgggtcttatggctacatagcgccagaatatgcctacacactcagagtgaatgaaaaaagtgacatcta

SEQ ID NO: 340 - DNA, 784 bp, Pinus radiata
gaaatatttaactagtgggaggattgctggtattgcagtagcagggctgttaactctcattgcagctgtgcttattattatgttctttgtaacaaggaaacaggataggaattcaggcgtggaaaagaaatataaaggcagggataaatataaaaatgaggagaagatattttataaagatgtggagaaggaaataaaggcaaagtcttctttggctgaaccacctactccagttactaaaccagttcagaatgagaaccaagaagaggaagccaatactggattggaagaagtgagtataaagcttcctcccattgaaaaatacaaagcaccggttaatgtgcctctagaaaaaccagcatggaaacctcctgtgaaagcccccaaagaaccaatagcttcaactgcctatactgtagcagctttgcagcagtttacaaatagctttggacatgacaatctaattggagaaggtaacctcggccgggtttatagggcagagcttcctgatggaaagttgttggctgtcaagaagttggacacctcagcttccatgtcacaaaaggatgatgattttttggaagtggtctcaaatatttcaaagcttcgtcacagcaatattgtagagcttgttggttattgtgttgagcacagacaacacttacttgtttatgaatacatgagtaatggaactcttcatgacatactccattcaggggatgagctgaacaagaaattctcatggaatgttcgtgtcaagattgctttaggagcagcaagggct

SEQ ID NO: 341 - DNA, 858 bp, Pinus radiata
gtactggccccattccagtacatatttgtcagaattctagttctcttcagtatgtagatttttcactgaatagattcaatggcactcttaaggaaggcctggggcaatgtaggaagctccaagcattgaatgcaggattcaactctctggctgggccaattccaaatgatctctatggcatgtcatctttgaggcagctgcgtctgccttttaaccaatttacgggaacacttcgtgcagaaatagggaacttgtccaatctttctgttctgtccctttctgctaacagattgacgggacttattcctctggagcttggaaagcttgaaaatttggaggggttaattcttcacagtaatagattcactggtatggtaccttctcgtctgtcccaatgcaagaagttgaaaattctgaatttgaagaacaactctctcacgggagttattgaactgaattttacaagcctgcctgagctaatttatctggatttagctagcaacaatttgtctggcagtattccgcctagcttgtggacctgcaaaaatatccagtctgtgagcctggcaagaaacaaattaagcggtgaaattcctcctggcatggcatcccttcaggttctctcttttttctccatctccaataacagttttattaatattacaagcgccctaacggctctgcaggactgtcataaccttaccacgttggttctgtcaaagaattttaatgggggtatgattccaactgatatacatggatttcccatgctccggacattcagtcttggagattgtgctctttccgggcaagttccagtttggctcctgaaatgtccaaatttacaggtcttggatc

SEQ ID NO: 342 - DNA, 452 bp, Pinus radiata
gaacagtgcagatcgtgtttgtcaatagctctattaaacctctataatattacaatgcaagaaggggccgaagccctgttaggaaattgcagagttcggttcgagacacgccctttctcgcccctatttgccagcaacggttcgacgtctcagatatcgccgaaaaaatcttcgaaaaccctggccattctatgcggggttattggaggaggattactcgcgttttctgtatgcctgtatttaatgcgaaaaagaatgagatccgcgattctgctcagatcagtggtactcacacaaacggaagaaatgggtgatggcggctatggatcgttgttcaattcccaaatcgtctttagattggatacattgatagaagcaaccggaaagttccaagaagctaacaagcttggagagggaggctttggcgctgtatacaagggagtaacttcaga

SEQ ID NO: 343 - DNA, 1128 bp, Pinus radiata
cagatcggagggaaaagatctaaggtgcttccaatagctctaggcgtagtaggcgctacggccggattaattgcatccataggctttttcatgtggattcgacggaaaggtgaggaaagagaaaccagcttatcgcttgctgagctgaatccggaactcatttttaagtaccatgttctgagagacgctacttccaattttagcgcagagaacaaacttggcgagggaggttacgggtccgtctataaaggcattctacgtgacggccaagaggttgcagttaaacggctgaaaaaaggatcaagtcaaggagacggtgaattcttgaatgaagcaaatgtcatcagtcgtgttcaacacagaaatctagtgaaattgcttggttgctgtgttgaaagctcagaaaggctcctggtttacgaatacctcgagaacagtagtctcgacagaattatattcggttgcttctagcgctttaacttcttaatggccgcatggatctttgattcgttccagtttatgtatgtagcttcttaatgtttttacttcccgatatgcattgattgcagatacaacaaaatgtcattcgcttaaatggagagagcgatatgaaatcatagttggaactgcacgtgggctggcctatcttcatgaggaatctgacattcggatcatccatagagatattaaagccagcaatattttacttgataaaaattacaaacccaaaatagcagattttggtttagccaaactctttggagaagataagagccacgttagcactagaattgctggaacttttggttacatggcgcctgagtacgccttgtgcggacagctgacagaaaaagccgatgtattcagttttggagtacttgttcttgagattatcagcggaagaaagaatcaaagtttgcctcaacacatggtctttctcccggaagaaacatggagactgtataaggaagagagagcattagaggttatggatcccacattggagggcagatattcgtgtgaggaagcgatgagagtgattaaaattggtcttctgtgcactcaaggagctgcaacgttgcggccttcaatgtcgctggtagtgtccatgctgaccagtgagcgaga

SEQ ID NO: 344 - DNA, 1164 bp, Pinus radiata
tggaacttcgcgaacagtaccaaggggtttatttgcaattttctgggaattacttgttggcataatgatgataacaaagtgctgtcaatttcgcttccagatatggggcttcaaggtgagtttccatctggagtacagtcctgcaagagtatgacgagcttgtctctctctcaaaacagtcttacgggtaccattcccagggagctctgccaatggcttccttttctggtaagcattgatctctcccagaacaagtttacgggacctattcctgctgagcttcataattgcacatatctcaatatcctccacctgaatggaaatcaacttacaggagaaattccctggcaattgacacggctcgaccgtctcaaggacttaaatgtagcaaacaacaagcttactggaattataccttcattcactcacaacatttctgtctctagttttcagggtaaccctgggctatgtgggcctccccttaaaaatgcatgcgggactagcaattctagtataggtgttcccattggggcagctgttgcgggcgtattgattgtgtcattgcttggttttgccttttggtggtggtgtatcagaataagcccaaagaaattggctgaaatgaaggacgagaacaagtgggcaaaacggattagggctccgaagtctatccaagtgtccatgtttgagaagcccattaacaaaatcaagctttctgatctaatggctgccacaaacgatttcagcccagaaaacatcatagggtcaggcaggacaggcactgtttatagagcgacactggctgatggatctgtgatggcgataaaaaggcttcgagacactgcccaatctgaaaagcagttcaaggctgaaatgaatacgttagcccgattgaggcaccggaatcttgttcctcttctgggttactgcattgccggtcaagagaagcttttagtgtacaaacacatggctaatggaagcttgtgggacggcctgcacagcaaggagaatccagagaataatttggattggactgcaaggctcaaaattggaattggcggagctagaggaatggcatggcttcatcacagttgcaaccctcgtgtcatacaccgtaatataagttcaaacagtattcttcttgatgaagagtacgagcctaga

SEQ ID NO: 345 - DNA, 432 bp, Pinus radiata
ttgatgctgcagatcccaggctaaatgagtttgataaagatgagatgatatgcatgttacttgttggtatggcctgctctcatcccaaccctcaagaaaggccaacaatgagacaggttctgcaaatccttaccaaagatgcaccccctccacttatgcccttgtttaagcctgcatttgtctggcctgcccccggtatgactgatatccaatctagttctagtgattttagcacacagtaaaacagagcagctttgaatgtatagataagaagatcaagggaagtgagcagatttggggcaatcctctcttcccctcaaatttcctatttccttgtgtttggaacattgtttcggttggagaggatgtggagcagggatgggtattttcaattatttttaggaatttcgttttttcccattttctgtgtgt

SEQ ID NO: 346 - DNA, 601 bp, Pinus radiata
aaaaatctctcgcagctcaacataaacggcaataaatttacgggcagcctccctacaaaaatcggcgaactgcaaaatctcggcgagataatcgccagcaataatttactctccggtgctttgcctccgagcttgggaaagctgcaacaactcggaaagctggaccttagcaataaccagttaagtggagagcttcctgctgaaatcggctcctgcaagcagcttggggaaatcaatctttcaaaaaaccaaatctccggttcgatacctgcgaatctgggcagtttgtcagttcttaattatttagacctttcggacaatcttctcacgggctcgattccttccgagctcgggaatctgaagttgaatacctgcaatgtctcgaacaaccgtttgtccggtacagttcctttggcgtttgagagtccggtctatgaaaaaggttttttgggaaatcctgagttgtgtagccaggaggcctttaacggcatggagtcctgttccaaagaacgcagtgaaagagctaagcgaaggacttggtggtggctgcttcgttgcttgtttgcgttgtctctcattattttcatccttggactggcgt

SEQ ID NO: 347 - DNA, 724 bp, Pinus radiata
atcagacttgctgatcttatggcggccacaaatgactttagcaaagacaacatcataggatcaggaagaacaggcactatgtataaggcaacactgcaggatggttctttactggcaatcaaaaggttgcagtcttctgcacagacagaaaagcagttcaagtctgagatgaatattctagggcatttacatcatcggaatctagttccacttcttggctactgtgttgccaaaaatgagaagcttttagtttacagacacatggctaatggatcattgtatgagcaattacatgatcatgaaatagaggatggtagttatcttgattggactagaaggcttaagatagggattggtgcagctagaggattggcctggcttcaccacagctgcaacccccgaattattcaccggaatgtaagttcaaactgcattttattggatgaaaatcatgaggcaaagataacagattttgggttggctcggttgatgaatcctgtcgatactcatcttagtacttttatcaatggtgattttggcgacttgggttatgtagcaccagaatacatgagcaccttggttgctacattgaaaggggatatctatagttttggagtagtgcttctagagttggttaccagacagaaacctattgaagttacagatgtacaggaaagctttaagggaaatttagttgagtggatcagcatcttcaaaaaatggc

SEQ ID NO: 348 - DNA, 308 bp, Pinus radiata
caagcaaataaatgcagtcattggggaaaacagtttctgtttgcccaacccaggtccctgtgataagaaggtggatgtgttgctttcctttgctcagggtgttgggtatccctacgttttggcctctgactggaaaggaaacgatccttgtggtggttggcagcatgttacctgtgataatggaaacattaccattttggatcttgtaggattggatttgaatggaactatatcgcctacattggctagtcttaattctttgagggcattgttgttgagtaataataatttaacagggggtataccta

SEQ ID NO: 349 - DNA, 511 bp, Pinus radiata
atggattagcatatcttcatcatggttgctcacctgcaattgttcacagagatgtaaaatctaccaatattttgctggataaatcttatgaggcaaagatcgctgattttggtattgccaaatttcttcaagctcatagtggaagggactcaacgacagcatttgcaggcacccatggttacattgctcctggtagtacttttcttccctattttgcacctttgctatagaaaaggtagttctcttttgaggtttttatgggtttgcagttattgattttaaccttttccacagttcatttatttttgtatctatgtatcagttctgttttgaatggttcaataattatatccaattttgctatgcagaatatgggttctctttgagggttacagaaaagagtgatgtctatagttttggtgtggtcctgttggaactgcttactggcaagcaaccaattgaaccaggatttggtgagaacaaagatattgtatactgggtttcacacaag

SEQ ID NO: 350 - DNA, 445 bp, Pinus radiata
gctattttaatggctccatacctgagcaatatgggatgttcaagaacttaaagtatttgcacttggctgggaattctttaaccggaaaaattccaccggagctcgggaggctccacggtctccggcatcttgaaattggatacaatttctacgagggcgggattccatggcagctcagcaacatgacagagcttgagtatttggatattgcgcaagctaatttgtctggggctttgccttgggaattgggtatgctgaggaagctgaatgctttgttcttgttcaagaataatctcagcggcacactcccgcctcagctcagcaacctccgcagcgtcctgtctttagacttgtccaacaacacgatctcgggttcgattcccctggggttctctaggcttaagaatttgaaacttctgagccttatgtataataatctgagcgg

SEQ ID NO: 351 - DNA, 717 bp, Pinus radiata
gtgggttgcggttggtctgactggttttattatagtagtagtgttagtcgttggaggggttttctggcggcgagggcatgagaaccgcaagtctgttcgtgttctggacagagccctgacggattcgaccgggggacctcgtaagttcagactgagggaagttaggcgtgctactcggaattttgataggaaaagcctgctgggtcaaggagggtttggggctgtgtacagaggggtgttgtctaataaaacccctgtcgctgtaaaacgtgtttcggagaactctaatcagggtgagcaggagttcatggcagaggtcatgattattagtaggcttcgccacaagaaccttgtgaggctgttgggttggtgccatgaagataacgaactgctgctgatctatgacttgatgcccaatggtagcctggataagttgatttttgaagaagatgcgaagcacgaggttctggactggcatcacagatgcaagatagtgtgtggagttgcctcggctatgctctatctgcacgaagaatgtgagcagcaggtgatccacagggatttgaaggctagcaacatcatgcttgattctgattacaatgctcgtctgggtgattttgggcttgctagattgattgaacttaataagaactcttatacaacaactgcaatagcaggtacacccgggtatattgcaccagagtactttcacaccgg

SEQ ID NO: 352 - DNA, 380 bp, Pinus radiata
caaacgagcgacatagatgctttgaattctttcagggccaaagcagatccaggtcatgttcttgatggcaagtgggttaatggaaccgatgtctgcacatgggagggcgtcaaggaatgcatcgatggcagagtcacaaaattgtcgctccagtattcgaggctgaacgggacattcgcagacgggtcgctcagccagctgagcgaactccgagttctgagcctgaaaggcaacgggctcaccggaaccgtgcccgatctttgcggattgacgaatctgaagatcttgtttctggatcacaacaggttcactggtccgttcccggaatcgctcacgacactgcgtcgccttgtggtggttgttctctctttcaatcagtt

SEQ ID NO: 353 - DNA, 371 bp, Pinus radiata
tggaaggaatcgagcaaggagacaagcagtttcgcatggaagtagcaacaataagcagcactcatcacctaaacctggttaggctaattgggttttgctcagaggggcggcataggttgttggtatatgaattcatgaaaaatacttctttggatacttttctttttgaatcttcagagcaaaccaggaagttagattggcagacaaggctcaatatagctcttggcactgcaagaggaattgcctatttacatgaagaatgtagggattgcataattcattgtgatatcaaaccagagaacatacttctagatgataatttgaatgccaaggtctccgattttgggcttgcaaaactcattaatacaagg

SEQ ID NO: 354 - DNA, 477 bp, Pinus radiata
tacatgaagactgcagaaatcgcatcctgcactgtgatataaagccccacaatgttctccttgatgctaattttttgcccaaagttgcagattttggtcttgccaaaatatccgacagagaggaaagtcacgtctctgtggcgaatagaggaacactaggctacgctgctccagagatgtggtcaaggctgtatggagttgtcactgataaatctgatgtgtatagctatggtatattacttatggagatggtggggcgaaggaagaacatcgattataagtatctagaaagtaactcgagtaaattcttctatgcagagtgggcttttaaacaagtggaaaagggagaattcgaaaatctaagaaaagaggacatgtcagaggaagaccaagtcatcgccaaaaggttaagtttagttgggctctggtgcatacagttcaaggcatctcgtcgtccctcaatgagcaaagttgtcc

SEQ ID NO: 355 - DNA, 536 bp, Pinus radiata
ctttccaaagcaatcaagccaagccgtgatagaattccatacggaaattgaagccatcagcggtgttcttcacagaaatattctccgcctacttggatattgcactcacagacagaagcgtttcctagtttacgaattcatgccaaataggagcctcgacatacacttgtttggggatagaggaatttttcttccatgggaaacacgttttcagatcataacgggaatatcccgaggtcttgcatatctgcacgatcattctcgggttcccgttgtgcacagagatatcaaagctgccaacatacttctggatgacaatctccattctaaaatagcggattttggattggcaaaactttttccagacgacagaacccatattacaaccgatgtgggtggaacaatagggtatatggctccagaatatgttgttcatgggcacttaacccaaaaagctgatgtttatagttacggggtgcttgttttagagattctgagtggtcgtaggtgcatggatccaagacttccatcgccga

SEQ ID NO: 356 - DNA, 693 bp, Pinus radiata
acaaaatacttcacctgggtatttggagaaaaatggggaggaggagaaacatggaagaggaggtggaagaggccaatcggagaatcgtggaggcagaatcggctgctatagaagctcatgtaaaggttgaagagtacgaagcaatctgtgagcagctcacgacgctcatcaaggagaaagaagatgccatacaacagctccagaatgatgccagaaatgccatcaaggaaaaagaagctgccattaaagaacgcgatgaagccagggagaagctcaagaagggagcgccaccgggaaggcgattcacgcgctataccatccaagaactcaaggctgcaacagacaatttctcggaggatgcagtaattggggaagggtactacggcaaagtttacagaggccaatttcacgttactccagtagccattaaagtcttgaaactcaattggtttcagggaagctctcgatttcaccgcgagatggatcggttgagcagtatcaagcaccctcgtttggtgatgttaatgggggcctgcactgacggagggttcattgtctacgaatatatgccgcgaggaagcttagaagatcggctgctctgccaaggtgggactccgccaattccatggttcgacagaatgcgcattgcggcagaagtctgcgagggtttactgttcatgcacagcttacagc

SEQ ID NO: 357 - DNA, 360 bp, Pinus radiata
cgacataccggccgtagagttacaatccgtaccctggtagtgacagaccttcaaattgggagcttggctaccatcccaatcagatgcaaatgtccatcccaagcccaactgaacaatgggatcaagatgctcataacatacgttgtgcatccggaagatactccgtcaaatatcagccagaaatttggcgcagatttgcagaatttgatatcttttaatggtataaattcaaccctaattccttatagcacacttttggttcctgtttctaagaagcctgtgcttactcaacctcctccgtcagccccatctcctcctccacccccccctactgtagtaaataatactacttcttcagga

SEQ ID NO: 358 - DNA, 537 bp, Pinus radiata
cttttatttgcgatttttgccattgtctttcaattgttgcggcgcaagaagccacatgaatcttattttgatgtgccagctgaagaggatccagaggttcacttagggcagcttaaaaggttctcattacgggaattacaggttgccactgatgggtttagccaaaagaacatactagggaaaggtgcttttgggaaggtatacaaagggcgccttgctgatggttctttggtggctgtgaaacgcttgaaggatgagcgtagttcagctggagagttgcagtttcaaacagaggtggagatgatcagtatggcagtacacaggaacctcctccggcttcgtgggttctgtatgtcaccaactgaacgtctactcgtttatccttacatgtctaacgggagtgttgcatcttgtctacgagaacgacagacagatcaagaaccactagattggcctaaacgcaggtgcatagcactgggttcagcaagaggcctttcctatctacacgatcattgtgatcctaagattattcaccgg

SEQ ID NO: 359 - DNA, 564 bp, Pinus radiata
tgaacattgcaattggttctgcagagggtattgcttatcttcaccatcatgcaacgcctcatataattcatggggatattaaggcaagcaatgtactgttagatacagactttaaggctcaagttgctgattttggatttgcaaaactcattcctgaaggggcaacacatgttaccccacgagtgaaaggaacactaggttatcttgcacctgaatatgctatgtggggaaaagcttctgaaggttgtgatgtttacagctttggaatactattgcttgaacttgtaagtggtaagaaaccagtagataagatggactcaaacacaaagtacacgattgttgactgggcacttccgttagttttagaaggaaaatatgatcaactagctgatccaaagttccatggaaaatacaatgaagaggaattaaagcgggtagttcatgtggcaattatgtgtgctcaaaatgccccagagaagagaccgatgatgctggaagtagtggacttcctcacaggtgagtcaaaagaaaagttattcaagatgataaatataaatattgaga

SEQ ID NO: 360 - DNA, 499 bp, Pinus radiata
gggattacaaggtacaatttctcctctgctcggcaatctctcctttcttaggatgctagaccttagtaataacaattttcatggtcacattccctatcaattcggaaatttgtttcgcttaaacacactttacctgtttctcaatcaactccaaggctcaattccgcccactcttggtcggtgtcgtagtttacggatcatctctatggagaccaacaatctcacaggtacaatcccgtcctggttgggaaacatatcctctttggaatacataaatctgggtagaaacaaccttcacgggagtattccgtccgaattgggcatgctaagccagttgagatttatacaactgggggttaacaatctcacaggacaaattccatcttccttggctaactgcaccagtcttcaagtattggccattgtaaataaccactttactggtaacattcccgctgagttttgtaccaagaacacccagttgacggcactctttatg

SEQ ID NO: 361 - DNA, 366 bp, Pinus radiata
gttcttggcaatgtccgccacaggaacatcgtgaggcttcttgggtgctgttccaacaatgagaccacgcttctgctgtacgaacacatgccaaacgggagcctggcggatctcctccacggcaacaaggaggccaatgtgctggccgactggatgaccagatacaagatcgcagtcggggtggctcacgggctcatgtatctccaccatgactgctaccctgtcgtggtacacagagacgtgaagcccagcaatatactgcttgatgctgatatggaagcccgagtagcagattttggcgtggctaagctcattcagactgatgaatccatgtctgtaattgcaggctcctatggctacattgcc

SEQ ID NO: 362 - DNA, 486 bp, Pinus radiata
gttgtggaagaatcagaccaagtactgggaaacaggtgtctggaatggccaaatcttcagcaaaattccagagatgaggcagaattccatctacttatttagctttgtcaataacggttcgtacaagtattacacctattctgtgaagcctgaattaacatatctctcgcgtttcgacgtggacgagtcgggagaaattcgagtttaccttatgctcgccaataacgagtggagcatgttctgggcactgcccagggatcagtgcgacgtttatgctgtgtgtggttcttatgcatcatgcaacggtaacaatgttcagttctgcaactgtgtgccgggctttgtccccaaagatagccgcgaatgggattctcagcagtggtcaagtggctgtgttcggaaaacgccgttacggtgcaaccatgccggaaacgggagcaccaccgatggatttgtagagttgagtggcaaatctatgcccgctca

SEQ ID NO: 363 - DNA, 522 bp, Pinus radiata
tgataatgtgctgaaacgggttatctacttgactcttccttatcacaaacttcgtggttctatatcacctgaaatgggaaagctgagtcacttggaaagattagtgctacatgacaacaatctttatggcaccattcctcaagacttgggaaattgcacacagctgagagctttatatcttcaggataattttttgagcggcataattccttctgagtttggaaagctttcagagctgaagattctagacatctctagtaattcgcttagtggtgtgattcccgcatcacttggaaaactgacaaaactttcgatcttcaatgtttcgaccaattttctgactggcccaataccagctggtggtgctctcaacagattctctggagaatcatttgttggtaatcttggcttatgtggtaaacaagtaaatgcaatatgcagaagtgaacttgaggggcctgtttcaagttctgaacctcctgttcaaggagtatctggtgctccaaatgaagtgacattgcc

SEQ ID NO: 364 - DNA, 504 bp, Pinus radiata
gacttgcgttgggggcaatgtaagcacgctcgatatcgcagaccagcatttcgtcggcaccatatctccggcgttgtcgagccttacctcgctcacgcagatcatactgagcggaaacaacctcacgggttcgattccctccgaccttacccagctgccgaatttaaagaagctggatgtaacaaacaatcagctgtcgggtgcaattcccaagttcgcctccagcgtgtctgttctcacaggtggcaatccacagatcgggaaatccccttcacccgggtcatctccacccggggcctcatcgggctcttcaggtaacagcaacgggacgtcgagcggcagcaatgccggtggtggcggctcagggagcaaagcctggatagctggggctgttatcggcgtcctggctctggtactcgttgcggggttgtgctactgctatgcgtcgaggaagcgtcaaaagtcgacccgcgtgcagagccccacaactgtggcgattaatcc

SEQ ID NO: 365 - DNA, 515 bp, Pinus radiata
gatggaaagcgtgataatatggcgttgctgtttcatggcattattcttacttggactgctccaacttaatgtaatttcagtttcagctgccctttcgaaatccgatccgttcatttatgggctctgcaacgtaaacaaatacagcaatggcagtgcgtatgaaaggaacgtgaacgccgtattggagtacctggtgagggccactgccccacgaggcggattcgcgacatattcttatggaggagtcaacggccttctacaatgccggcccgacatctctcagcaggactgccaaaagtgttccgctaaagcctcacagatggcttatcaagactgccctaatgccattggagctcggattcagctggaattctgcttcattcgttatgagaattatactttcgcctctgttctcgataccgttcaagccgctgcttttgagaatgtgaagagcaacggtgatattgaaggcttcaatcagactctagggaatcttatgaatactctttctggca

SEQ ID NO: 366 - DNA, 981 bp, Pinus radiata
gcacgagcggctccattcctgcttcgtggggtaatctttcaagccttacggacctctaccttaacggtacagggttggcgggttcgattcccgagtctatcggagagctttctaagcttcaggatcttgatctctctaacaactatctctcagggagccttccaaaagaattatctaagctttctgatctgcaaaacttggatgtttcattcaataatttcaggtttgtgactgtgcccacagtaatatcgaacctcactggactgcttcagctctctctcgctggttgtggtatcgagggtattattcccaagtggttgtcgacgatgccaaacggtctgagtacgcttgacttgtcgagcaacaacatcacgggcaccataccgacatgggtgggcaacatgacaggattatacaatctcaacttgtcaaacaacgcattaacatcaactcttccagaggcgatgagcaacctgcgaaatctgggcgttctggacctccattcaaattacctaacgggacctataactgccgcattctccatgcaaagcccgtttccaactgggcttttagagactgtggacttgtcccgcaacaaattcacggcctcaataccttcgagtgtgggcaatcagaacggtatgcaacagttggttctgtcgcacaattcactgcgcggagcaatacccagtacgttggggagtttggcacaattgcagactctggagctgaatgaaaatcacttaaccggcaaaatacccaacgcgtttgtgaacctcacgtctctgttgcaactgaacgtgtcgcataattccttgtcaggaatgattccggttggggggctgcttcagaagtttccaatttcttcatactctggtaacagaaggctttgtggagatcctcttcctgcttgctgatccatgagtattcttcaacaattcgagactcggaaccatgccaggttgctcgtgtatttatgtt

SEQ ID NO: 367 - DNA, 402 bp, Pinus radiata
caattcctcatcatattggccaatgcctggcactagaggtgttggatttggctaaaaacaagctgaatggacagatccctccatccataggcaattgtaaatccatgaggactttattattgcagagcaacttcttgtcagggaaaatgccaccaactttaagtagatgcacagtgctacaacggctgaaggtgtttgaaaacaaacttagtggaaatctagacataagatttcctaattctatggaagttttctctgcttattctaataacttttctgggaatttccctgcttctttggcggaatgcacccaccttcaattattagatttaagcaaaaacaaattaacaggtcagctaccgggttatcttgcaactcttcaggaattgagagttttaagtg

SEQ ID NO: 368 - DNA, 869 bp, Pinus radiata
gatgctgtgcagaagaaggacatcgcattttggtctatgagtaccttgaaaataacagcatttctcaagccttactaggttcagataacactagaatggatatggattggacaatgagagccaaaatctgcatgggaactgctcgtggtctttcttttcttcatgaagaacttgtgcctcacattgtacacagggatatcaaggctagtaatatactcctggacagagatcttaatccaaagattgcagattttggtctggctaagcttttcccagataatgttacccacattagtacaagggttgctggcacaattggttatttagccccagagtatgccatgcgtggtcagttgacgaagaaagctgacatctacagctttggggtacttgtacttgaggtaattagtggcagaagtaacacaaagtcaactttagcagttgaggagcaatttcttttggagtggacatggcaactgagggaagagaacaggctactagaaatcgtcgatccaaggttagaggagtatccgaaagaagaagtattgcgtttcatcaaggttgcacttttgtgcacacaagctgcatcaaatttcaggccctctatgtctcaagtagtggcaatgctgtcaaaagagataaatattaatgagaacttactgtcacgacctggcttcatctcagacttcaaaaacttgaaagtagcagctggcacaaatagatctccagctgggtcacattttcatgcttttaatagccctcaagtggcagcatcgcacaagggagtctcatcatcttctgccacgacgtgcaactcaacaagcaatgttagcagctcatgtgccactatcacccagttagatggtgca

SEQ ID NO: 369 - DNA, 667 bp, Pinus radiata
tgtggtggtcatagtctgcttgattcttatatgtatcctgtataagacatacaagaattttgctcaagctaaatcaaagacactctcttggaaactcacaccctttcacaggctggaattcgacgaatcagacattttgaagagattgacagaaaataatgttatcggaagtggaggagcaggcaaagtgtacaaggtgactctgggagatggcactattgttgctgtgaaacagatctggaacaacaggaaactgcagttgggccaagacaaggaatttcaagcagaggtggacactttagggaagattaggcatgccaacattgtcaaactgctttgttgcatctctagttcagattctaatctgttagtgtatgaatacatgccaaatggttgcctgtatgaacggcttcataattctgaaggggaaaccctggattggcctactcgttataacattgctattggtgctgctcagggtctgtcctacttgcaccatgattgttcccctctaatagtacacagggacgttaaatcatataatatattgctggattctgaatggaaagcccatattgctgattttggtttggctaaaacggtggagaagctgagtcaggagaatgtcactcttctcattcactttgagggtgtaagcatactctgc

SEQ ID NO: 370 - DNA, 366 bp, Pinus radiata
gttctggccgcatagattctcttacagggagctcaacatcgccacgaatggattccgtgatgaaaacgttttgggcgaggggggtttcggaaaggtttataagggcgttcttaggggcagtggccagcaaatcgcggtgaaatctttaatgaagcaattcaagcagggaatgaaggagttcgtggcagagatctcgaccatggggcgtatgcagcacaggaacctggttccactccgggggtggtgtaggatgcagaagcagctgttcatcgtttacgactacatgcccaacggcagtctcgataaactcatatttgggaaaccgatgaccgtcctgccatggccgcagcgatacgcgatctttga

SEQ ID NO: 371 - DNA, 337 bp, Pinus radiata
gtgaactgaaagaggctacaaagggattcagtgacaaagagctgttgggttttgggggttttggaagagtttataaaggtgttattcccagcactggactggaagttgcggtgaagagggtttcgcatgaatccaagcaaggggtgagggaatttgttgcagagattgcgagcattggccggcttcggcacaggaacttagttcagcttcaaggctggtgtaggcataaagatgagcttctgcttgtatatgattatatgccgaatggtagccttgacaagcacttgtttgagagtacaaagaatttgttgaattgggcgcagaggtatagaattct

SEQ ID NO: 372 - DNA, 775 bp, Pinus radiata
gaaaatcagaatttcgagcatcgtaggttctccattctccattggccatgacaatcctccacagcagagtttcgtgctcgacacttctcttgatgataattactcttcagtcgcagattgcaaggcactacagtattctaaatgccactacaattttaactatacaacagacagtaagtacgagagaaatttgaacagtgtcatgactaggcttattaaagattcgtcccacacagggtttaacacttctgagaatggccaagtatatggccttctgcaatgtcggggagacacaacacccgaccagtgctacacttgttcacaacaagcaaacactactcttcgacaaatttgtgggaatgcaggcggcggtttattgtggtttgacgatgaaaactgctttttgcgttatgagaactatagtttcttcggacaattggaaaccactgatgaatggaatctttgtaatccgaaaaatgtcacacctagtcctgatgttcttattaaggctgttaacagcttattcaacaagttggtagatgaagcaacatctggatctacattatatgcttctggaacaacaacagactccttgtctcgaaggatatacggtctggtccagcgcaccagagatatgtcgatagacaactgcacatcatgtttgcaaactacaatcaacggtatttctacagattgcagtggaagccaaggagcacggggtttggtgggaagctgcatagttcgttatgaaatgtatagtttctttaattcgact

SEQ ID NO: 373 - DNA, 429 bp, Pinus radiata
tggactactggatccttattattctctgttttgcgactgcagcatcagcgcaacagtcgtatgaagaaaacgctcagctgaattgcaattccgacaattcccccgacatcacatacggctacacctgcaatggccaacagcagacatgccaggcatatgcaagttacagagctcaaacaggttatcagaccctggcaaatatcagctcactgctcaattcaaacaaatcccagatggctcacatcaacaagctctcagacacccagctcctcgacatggacaaagcagtcatagctcccatcaactgttcctgcgatggaaactactcgcaggccaacacaagctatgttgttcaaccaaacgactcgtattttatcatggccaacaacacttaccaggggctctctacttgccaggccatgatgcagc

SEQ ID NO: 374 - DNA, 547 bp, Pinus radiata
aagaacagttactactgttaaggctgcgaaaatggatatcttcgttctctcaggacagagcaacatgtcgggcaggggaggagttcatggttctcattgggatcatttccttcctcaagaatgcaaagcacacccttcaattcttaggctcaactcacatcttcattgggagcaagctcatgttcctttgcatgccgatatagataaacacaaagtgtgtggagtaggtcctggaatgatatttgcaaacactatactgaagcattataaagatcccaaaaaagctcgtattggtttagttccctgtgccattggaggtaccgcgatcaaagaatgggaaaaggacagcacactctacaagaatatgataactagaaccaaggcagctctcaatcatggaggcgttctaagagcaattctctggtatcaaggcgaaagtgatacagaatctgagaagaatgctaatagctataaacataatctcgagagacttatccatgatatccgctctgatctgaaacatcccgatctccttttcatccaggtg

SEQ ID NO: 375 - DNA, 757 bp, Pinus radiata
gtccgatcctcggctctgttatttcccggcctgggccatgcttagggctctggagggaaagtacatggatctggttgataagaggcttggggataacagtgtggacacagagggtgttacgaggatgaccaaggttgcgttctggtgtattcaggataatcccaaccagaggccatggatgagcgttgccctgaagatgttggagggtgaatgggaaattccagatgcgccgatgtggttgttgcagagagggcccgagttcttggaagggtatgggtacgagcccatggagaatcgcaatggagatgatgaagaaccggacgagacgtcctcagtaaccgggaacagcatgggtgttcgcaggtcagacgaatccatttcttccacacaattgtctggacccagataacaactaaagccgttggcctcaatcagcacagctgtccagagagttgcaagataatgtatagcccgtattgtcatctcgccccgcccaccatatcgatgggtttgaggttttgcatctcgattttatgaatctttgaaagcttcgctctctgtttctatgaaggtttgctaatgcagtcgagctgctaacggaatcccctttcaacacaaacatacagatacttcgctacgttaacggagtttaacttcgttttcgaagtatgtgaaatgtgcacaacgatattcagactgattacagactacagtttcagcatgttggcgtttttgtccaggatgcctgtgcgctaca

SEQ ID NO: 376 - DNA, 500 bp, Pinus radiata
ccacattccgtcggagttgtgtaccaagaagaccacccagttaatggaactctatctgtctgataatcagctgagtggcagcattccttcatccctcttcaattgtaccaagttacaattgattgagttagcaaataaccagctcagcggaatagtgcctatggagttgggtaaattgacacatctccggcggctttacttgggccgcaatcaccttattagcggcaacaccacgacatgccctattcttactgctcttagtaacttttccgatctacaacttgtagacttctctgtgaataacttcactgggcaattgccgttttctataggccacctctctacaaaactcgaagtattactcttgagtgacaacgaattagctggagagatacctccggctataggaaatttaagtagtttaacattccttagtttagcaaataattcttttacagggtcaatcccttcttcagttagtatgcttagaaagttggaga

SEQ ID NO: 377 - DNA, 989 bp, Pinus radiata
gttatggcgacgcacatgaaatcagtgcttggcagtgtgttacttatagtgactctagctggtacgtgtatgcgcttagcagttgctgatccagagactcccaccgtctggagcaagtgcggagagagcggcaattatacatatagaaatggtagcgcgtttcagcttaatctaaacaagcttttggattcgctggtgaacaatgtttatgccaccggattcaatacctctagtcttgaaggccaaaacagcaatggtgctgtttatgggcttgtccagtgcaggggagatttagattctgccgattgcaaacagtgcgcatccacggccagggcaaatcttgttcgggcatgccacaacacttctggattcattcaactagacggctgcttcttacgttatgacaatcataacttttacaatgaccttgagagtaggaagaatacaccaataagtgttctctgcaacactggtaacagcagtcggccacagcagttcacagatgctattaaggcccgcctctcaaatattacccttgaagctgctcagagtcccaagcttttcgctgcagacgcagccgatgagccttctagtttaacagggaagatctacagcttagctcagtgttggagagatctgtcccgcacaagctgcggatcgtgcctaacttatgccttagaaaatatattcaaatgccaaagtggagctcttggggcacaattcggatctcagaactgctatttgcgttacgaggtttatgaatttttcgacaattccgttatctcgcaacctccagcagaaactcctcccgtatcctccggacgtaaaaaatctaagacacttgcgataattctgggcgcagtagccgtcggtatccttggattaattgctgccatggtgattttgaggaggaaatatttctctaatgtcaaaattacggaagagaaacctgtaaaatgagtgaaaaaatcttccctctcccacaaagc

SEQ ID NO: 378 - DNA, 486 bp, Pinus radiata
gtaaatttggttcgtctgcggggattttgcacagaggctccggcaggctgctggtttacgaatacatgcccaacggctgcctcagcgacttcctgttccacaaaaagcggaacaatgatgagcagaaggtgctggactggaaaacgcgcttcgccatcgctgtaggaactgcgcggggaatcgtttacctgcacgagaagtgcagggactgcatcattcattgcgacatcaagcctgaaaacatcctcctggattccaatttctgccccaaagtggccgatttcggtctggcgaaactcctgggcagagagtatagtaaggtcttgaccaccatgagaggaaccagagggtacttggcccctgagtggctatcaggtcttcccatcacgggcaaggccgacgtctacagctttggtatgacactgctggaaataattggagggcgaagaaacatggacggggaccaggaatccagcgagatgttct

SEQ ID NO: 379 - DNA, 744 bp, Pinus radiata
tttcactatctcataattcgtatacagggacagttccaatcgagcttcgcagtcttagaaatttgtattctctggacctcggaagcaatcgtttcagtggcccctttcctccttcactgggtgtcctcactcaccttcaacgactgttcttagacagaaattacttgactggaagaattccaaacgagataactggatgcagagagcttgcagagctgaaacttgactggaatcaattctcaggtaccattccagaggcaatatcaaatcttgaatggctgaatttgctcagcttgtctggcaatttgctcagtggtcctatcccggagagcctcagaaagtgcattagactccagaatctggacatttcttataacaagcttacaggttccatacccagatctgtggctagcttcaggggattgcagataaatttcaatttatctaataatctattaagtggttcaataccatctgagctgggaggaatgcaaatggtgcagttcgtggatttgtctaacaataatctctcgggagcaatcccctcttctattgctggatgcgttggtcttcagggactcgatctgtcgggaaatactttgctagatcagattcctgtggctctgtcgcgtctgcagaacttggagcaatttctaaatctgtcaaataatcacttacaaggagagatacccgcggaattaggcgaacttaagttattaagaagtctggatttatcttcaaata

SEQ ID NO: 380 - DNA, 788 bp, Pinus radiata
caaaatcttccagagcaggaagttgatattgtacaatgggcatggagtctgcaagagaacgacaagctgatcaaaatagttgacaaaagattagaaatgaagtacaatccggagcaggcattttgcttgtcagtcataggccttctctgtactctgagtgatcccagttccaggccttcaatggaggaaattgtttcatatatcaaggcagagaagtcactgccactcttgccttcaaacagacctactacatatttcccctatcccagcacaacagaactctgcaacctcaattcctgctcatctaatgtaaagatcgatctccttggcagcagcagcagcagcaagtagttatgcgtaagtgcctggggtgcatcctccattttccaatgtctgtaactcttcttcctccccatctccattcaattcattggtaattccagtttgggtgtgtgaatgcctcattttcctgcaagctatgtcatttctaagttcattttaggttattgaatggttcagtttccttccagtctgtaacagccatggatatgtgttcatataacattcttcatcattattgcgcagtactgtttattcctctgatccagataaaatctggaccatcttcatcatatctctagcccacatgaatttcatcactaccacccacctacccaccgttcatgtttcgtacgtcgtggaataatagctcagtgatagcagcaacagcttctctttctctggaataaatttttcaatatattttacgactcaaaaaaaaaaaaaaa

SEQ ID NO: 381 - DNA, 562 bp, Pinus radiata
tctaagctgttctggtgcttggccgcattattgtgtggcatttgctgctgccattcgttttcccctgctccctcgcctgtggactttcaggagataagcggtattcagcaatgcaaccagagtgatgtgcaggcattgatcagtttcaagcaaactgttagcagttcgagccctctgaattgggaggtcaacaggagttgctgcacttgggagggcgtgacgtgtggattattatctctgcagcagtttagcgtcacaaagctccggttgccaggaagaaggctcaggggaactctttccgactcattaggtcgattggctcacctcagagagatcaatgtttcattcaatttgcttactggtgaagttccaggtaggctatttcttttacagcatctggaagtattggatttaagtttcaataatctctccgttattgctccagttgcacaagggcttaattctattcgtactttcaacatttcaagcaatagttttcgaggaaatgtcccccaacttggctccgctgtaaacctcacatcctttaatgtcagcaacaact

SEQ ID NO: 382 - DNA, 1555 bp, Pinus radiata
gcggccgcgtcgacatggcttctctgataggaatagtaccgttgctgctccttctgacgctaattcctgcgaccgagagcttcaatgatacagaggcattactccaatttagagccctaacggattcccatggcattcttgccaaaaactggagctcggccgatgcctgcactgggaaatggcagggcataacctgcaaaaacggcagagtcttcttcgtttcgctttcgcgccatgagttacgaggccctatcgatcctctttctgcgctcgaccagctccgggttcttgatcttcagggaaatcggctcaacggcagcttggatccattgtcaaattgctacaatctcaaattgctctacttggcttccaatgacttctcgggtctgattcctgctgatcttgctcggctcaggcgcctggtgaggctcgacgcttccgataacaatctccgcggatcgattccgccggtgatacggaaccttacgcggctagtaactctgcgcctgcagaacaacattctgtcagggccgttgccggatctcagcttcttgggggacttaaatgtttccaataatgaaccttctggccaagtaccccgccaacttctggagaagttcccggcttcggccttcgccggcaatgctgggctctgcggacggagtccttttccggcctgtaccattccgccaccggtggctgtagtggtgccgtcgaatccgagctccgacccgggatcgagtactcccgtggacacgagatccaaaaccagggctctcagcacgggggccgtcattgcaattgtggtcggggatgctgccgttctgattttgataacgctaatttttctggtgtattactggaagaaatacgtcagggaggccgaggttgctggaaaaacggcctccgagaagatggatttctccggtggcgcgcagacgccagagatggagaagagtaaacttgtgttcttcgataggaagaagcagtttgagttggaggatctgctgagggcgtctgccgagatgttggggaaagggagctttgggactgcttataaagccgttcttgatgatggctgtgttgttgctgtcaagagattaaaggacgttaatccttctgggaagaaggaattcgatcagcacatggagttgattgggaaattgaggcatccccacatagttcgtctcagagcttattattatgcaaaagaggagaagcttctggtttatgattatcttcccaatgggagcttgtattctcttctacacgggaacagaggtccaggaagaacaccattggactggactacaagaatcagtctagtcttaggagctgctcgagagtacttctagagcggccgcgggcccatcgattttccacccgggtggggtaccaggtaagtgtacccaattcgccctatagtgagtcgtattacaattcactggccgtcgttttacaacgtcgtgactgggaaaaccctggcgttacccaacttaatcgccttgcagcacaatccccctttcgccagctggcgtaatagcgaagaggcccg

SEQ ID NO: 383 - DNA, 275 bp, Pinus radiata
ggccggtgggggaagtttggagatggtgtagatattgttcaatgggtaaacaagatgactaactcaaccaaggaaggagtttcaaacattttggacgagaggctgtcttcagttcctttgcacgacgttatccacgttttctgtgtggcaatggcatgtgtcgaagaacatagtgtagagaggcctaccatgagagaggttgttcagatgctcactgacattccaaagatcaaaccttctgaaaatcccctacctgcttcagaaggagctgaatc

SEQ ID NO: 384 - DNA, 573 bp, Pinus radiata
agctatggtactgtgtataaggcaaagttggttcaaggaagtactattgtgcttaggttgcttaaagaaggcactgttagcagcagggaattattcttgcctgcagttactgatttggggcgtctccgacataataatttggtgcctctgagggcattttatgagggtgaaagaggagaaaagttgttggcctatgattatatgcccaaaggtagcttggccgatcttcttcatggttccggcaggcagcatctgaactgggctcgtaggcaaaagattgctcttggagcagctcgggggcttgctcatctgcatacagggcttgaaacacccataattcatgggaaccttaaatctaagaatgttttggttgatgaatactttgtagcccatctaacagattttggattggctgggctgatgagtcctaatgctgcggccgagatgatggcagctgcaagtctagaaggctacaaggctcctgagcttcagaaaatgaagaaggctaataccaagactgatatctacagctttggaattttgcttttggaaatattgatgggcaagaagcca

SEQ ID NO: 385 - DNA, 741 bp, Pinus radiata
aacggatagcacttggagcagcaaggggacttttatatttgcatgaccaatgtgatcccaggataattcaccgtgatgtcaaagcagcaaacatattactggatgaagattttgaagccattgtgggagactttggattggcaaagcttttagatcagagggattcacatgtcactactgctgttcgtggtactgtagggcacatagccccagaatacctttcaacaggacagtcatcagagaaaactgatgtatttggctttggcatactgctgttggaactcataactggacagagggctctggacttcggcaatgattccaaacagaaaggggtaatgcttgattgggttaaaaaggtatatcaagagaagaaattggaccttattgtagataaagatcttaaaggtttctttgatagggttgaactcgaggagatggtgcaagtggccttattatgcacccagtttcatccggcacatcgtcctaagatgtctgaagtggtgagaatgttagaaggagatgggctagcagaacgatgggaggcatcacagaaaactgaaactcctagctacagaagggctgaatcaatacccaggaagtattccgatttcattgaagacacttctttcgctgtacaacccatggaactttctggaccgcgatgattccactgtctttttggtggcattaaatatccactgcctggtcactatagtccaaacgagacgcgtaatcgag

SEQ ID NO: 386 - DNA, 342 bp, Pinus radiata
gatacaaaatagcccgcgtggcctgccggtgcgtcagaatgcgcggcaaggagcgcccttccatggacaaagtgacaacggagctcgaacgagcactggcgttgctcatggggacgccctgcgacgaccagccgattctccccaccgaagtcgttttgggtagcagccgattgcatagaaggtcttcgggatctaatgattcggagctccgtgcgccttcgtggatcacatttcccagcgttgcttcttctcagaggagaaagtcatcggtgtccgaagaaaacaagaacgatcacatgtgcctgcgttgcctagagggcggggagaggaaaccggagaacg

SEQ ID NO: 387 - DNA, 421 bp, Pinus radiata
attcaggcttcgcctctcttatctatctcttagtcttaacctcacaacaagcctacctaaagccattggcaacttgaccacgctgacctacttagcactttatcaaagtggactcactcacatccctgtagaaattgccaatttgaccaaattgacctccttagttctccatgagaataatctcactgacatccctgaatcgattgccaagttgaccaggttgacttttttggatgtcagtcacaatagactcgctaacaaaatacctgaagctattttcaatttgacgaagttagaaaggctatttcttttttcaaacatgcttattggtgacattcctataactcttagcaatttgagtcaactggttgtactagatatccataataatacattaagtggcaatattccttccactatt

SEQ ID NO: 388 - DNA, 432 bp, Pinus radiata
gctatactgtttctcctcttcatcttttctttctcctcctctgctcactcttttcgagatgatcggcactccctgatggcattcaagaagctgatttcagacgatccttatcattacatggcagattggagtcctgcagtccccatttgcaactggactgctgttacatgcagtcgtcgtcatccactgcaaaacagagtagtctccctcaacctcagttccatcgatctgggtggctccatttctccttaccttggcaatttgtcatttctccacacacttgatctttcaaacaactctttacacggtcatatcccaccccagttgggacgcctctttcgtctgaagaagctcagattgtcgtacaatcaattggaaggaagtattccaagcgaaatccacagttgcagaaatctggtttacatggcgctt

SEQ ID NO: 389 - DNA, 469 bp, Pinus radiata
agacagagttgtggccatcgatctcgatagcatggatctacgcggcaccatctccccttcgcttggcaatttgtcgttcctacgctcactcaatatttcaggcaataagctccacggccatatcccacctcaattgggacgcctctttcgtttgaggtggctctggctttacagcaatcaattggaaggaaatataccgcatcaactcagcagctgcagaaatttggtttggctatcgctctccttcaacaatctgagcggaattatccccggtgagttgggttccctgccacatttgcaagtgctttttttgggagcaaacagtctaacagatactattccctcttcattgtctaatatttctactttgactgacttggaaatttccaccaacacctcactggcagcattccacaagaactgggccttctcactcatctgcaaactctttaccttcatacaaatgaat

SEQ ID NO: 390 - DNA, 521 bp, Pinus radiata
cattcctgcttctatatcaagtttaagacagttgcagtcattggatttgagcttcaataatctaacaggacggatacctaatggcattggcggtcttgggaacttgcaaacgctgtccttgagctcgaataagttatctggtgccattcccgccagtttcaagaatctggctcttctatcttatttagatctcagtgataatcacctgaatggaactgttcctgcattcattggaaacatcaaggggctgcgttacttggaccttcgcaataacaaattccatggagtattgccattcagcacagcttttgtaaagaatcttaacaccttcaaagtgggggccaaccctgacctttgttttaatgcgtccatactttcctcgacaatatcaggcggtgcacagccctgtgacagtaaagggaggccatctaaaggaaatgcagattcaccagcatatgctcctgatgaattagctggaagcccagcgccttctaccgaggtagagcagcaacaccaccata

SEQ ID NO: 391 - DNA, 432 bp, Pinus radiata
gaggttatctgcaaagaacatggcagctatatttattgcagtatgtgctgtgtttagcatagtagtggtctgttgcataatggttcgtcgtcgaagttgttgctgtcagaggagttcccgtgagcagcagcagagcattcgagcttttatggatcctgcagattcgagacctccctcggttgagaatttcttaaattattattcatcacaagcgcctgcaaggtattcttatagtcagattataacttacacaaacaatttggaacacaagcttggcaaaggaggtttcggaactgtttatagaggaaaacttcccaatggacatctaatagctgtgaagattttggatgagtcgaaacagagtgagcaacaattcattgcagaagtggctacagtgggaacgacctgccacattaacctggtgcgcctatt

SEQ ID NO: 392 - DNA, 772 bp, Pinus radiata
gaactagttggcccaatcccatccaacctcacaaatttgcagctcacaaatctcaccgtggacagtaacaagctttctggaccaattcctgacttgaagcttcctccgggtggcttcacctactctgggaattctttctgccaatctgtgcccgggctttcctgtgcaccagcggtagctgttttgttggacttcttagcctccctgaattatccaattgatctagcaggatcctggactggaaacgacccatgtaattcctggataggtatcggatgcagcactggtacagtttctgttatcaatttacccaataggaatctcaatggaaatatatccccttctcttgtcaatttgccttcacttaaaattatcaagttgggtggcaataagctctctggtacaattccatcgactctaacccgattgaagtctttgagtactttagatttgagccataataacttgagtcctcctgttccaaaattctctggacaagtccaagtgcttactgctgggaatcctctgattgacaagtcatcagcacttcctcctgtaagcccttccgtgccaccaccttctgggagtcctccattaccaccttctgggagtcctccatcaccaccttcaaatggaccaccttcaaatggatctagcgctcccgtgccctctgcaaatggttctacaccaagcaatccggtctccccagcatctccagcaccacctagtgggagcagtgcaggatccaatacaaacagtagtaactcaaatg

SEQ ID NO: 393 - DNA, 383 bp, Pinus radiata
ggagaatctcagtgttgcatatcgactacgggaactcaaacctggggagaaaggacttgactggcctacacgaaaacaggtggcttttggtgcagctcgtggtttggagtaccttcatgagcactgtaatccaaaaatcattcaccgtgacctgaaggctgccaatattttgttagatgaagattatgaagcagttgttggtgattttggattagcgaagttggttgatgctaaaaaaactcacatcacaactcaagtgcgtggaactatgggtcacattgctcctgaatacttatcaactggaaggtcatcagagaagacagatgtgtttggatatggtattatgcttttagaacttgtcacagggcagcgtgccatagact

SEQ ID NO: 394 - DNA, 360 bp, Pinus radiata
ctcgaagaatccatagcaacagtagagattttgaaacagagcttgaaattatatgcaaactccgccacggcaacttggttaatttgttgggctattgtgaggagatgggggaaaggcttcttgtgtatgaattcatgcctcatggaactcttcatgatcatttgcatggaggtctctctcctcttagttggacattgaggttgaaaatctccatgcaagcagcacgaggcattgagtaccttcacaaagatgcatcgcctccgatcatccataaagatattaaggcctccaatattcttttggatggagaatggggagccagggttgcagattttgggttaactatatctggagaaagag

SEQ ID NO: 395 - DNA, 360 bp, Pinus radiata
gttctgccatcttccatgggagatctggttaatctggagcgtctttcgatagcgaataacatgatcggcggccctcttcctgcttcatggggtaagctctcgagcctgacgcagctctacatgaatgataataagctatcaggttcgattcccaaatctgtaggaaagatttctaagcttcagtttctatatatctctcacaacaatctttccggcagccttccgcaagaattatcagagctttctgatctgcaaatcctggatatttcattcaataatttcaagtttgagagtgtgcccacagtgatatcaaggcttcccggattatatgagctctccctcgcgggttgcggcatcgaa

SEQ ID NO: 396 - DNA, 545 bp, Pinus radiata
gagaggttggttttgccttagaaggaaggatgactctgaagtctattccgagaatatggaacaggcagatcttgtagctttggatgggcaagtaagttatgatcttgacgagcttctgagggcctctgcttttgtcctgggaaagagtggtgttggcatcgtatacaaagtggtgttagaagacgggctcacattggctgttaggaggcttggggaaggaggttctcagagattcaaagagtttcaagcagaagtggaagctataggtcgaattcggcactgcaacatagttactcttagagcctactactggtctgtagatgagaaactgctgatctatgactacatccctaatggcagtttagctgctgcattgcatggtaagttaccttttccttctaattttatttgtgaatcttaaattcaaatctcctacctttatctcattatttgttagcattagcagattttttcttaaaaatataggctttgcatatcgccaacatcattattctaagcctcgtgctatatattccttccaactg

SEQ ID NO: 397 - DNA, 657 bp, Pinus radiata
aattcatgggtaccgagacgcgtgtggaagcttagtctgcagacccacattggccttctgagacattagccttttgagtttggcatttgagcttttgctgtcttatgtagaaatacaaataagcccacatggttcgctttctgcaggaaatcagcggcacagatcatgttgaaaccgggaatggggaaaacaggcgggagagtattgctctggttgttattgttgtcatggcctcccttgcagtggtggcgttgttggtggccttcagctactattggtacattaagaacaaagtcaagaagaggttcaacactgaaaaatcccttcagcaaagcaacgaacttgcccctcctgtgatgaactcatcatcccagacagaggcacaagtctttacattcaagcaactccaagcagcaaccagtaatttcagctcaaacaatgttattggcaatggaggctttggctctgtgtataaaggagtgctgcaggatggtagtaaggttgctatcaagcagcttgaccaagcaagcaaacagggagaacaagaatttcgtgtggaggttgatgttttgagctgtctccattcaccatacttgcttgcattgattgggtactgtgcagaccatgatcacagactcttagtgtatgagttcatgc

SEQ ID NO: 398 - DNA, 840 bp, Pinus radiata
gaggctactagggtttgttgaagttgatcgcagaattgaatacggacttcttcgtttacgatataaaagcattcagtgaattgcacgacgcctctacaagcaaaagtcaactgatttgaggatttgtcggaaaaaatagttttgcagacaaaagtttatgatcatcacatttaagttatattttaagactgtcagttgtgaaagtaacgcttaaacaaaataatgggatgccgatggagaaacgcagtcaggcttcagttcttccaagaattttatgtcatcttgctattgcatttagctgttcgtaattgttggtctcttaattctgaaggcatggcaatgttggcatttcgagagtgtgtgcatatggatccgtacaatgccttctcaaactggaacccttatgatgaggatccttgcaaatggcgtggagtaagttgtgtaaatgggaaagtcatctctctggagttggtagatctttctcttcaaggaattctggcacctgaacttgggcaacttatccatcttcaaaaacttgcccttggtgagaacaatttctcagggagcattccaaaagaacttggagagttaggaaacctggagcttttgaatttaagacataatggcttggttggcaagattccttcaaatctgggaaatatgtcaaccatcaaaagccttcttctcacaggcaataaacttgacggcagcattccacctgaacttggcaatcttatctctctttgtgagttacagctggacagaaatcaattgtctggatttataccaggttttgaccctagaaatcagaaagccagcaaaagtgtcagcctatgtggt

SEQ ID NO: 399 - DNA, 347 bp, Pinus radiata
tcaagctgtttacgaataacttgaatggtagcttgccttcgaatttggggaaattttccggcctacaaacgctagatattgcaggaaatcgactgagtggtactcttccgccggatctttgcaagtatgggaagctgcaaactttgaatatctttaacaacaacttcactgggcagttgcctttgcaatacggtgcatgtttgagccttcaaagggtgagaataagccacaatgagctcatgggacaagtgcctagttcattctggggtctccctcacgtttattatctcgaactcagtaacaacaagttcgaaggctcgatttcttctgaaattaggatgccaaga

SEQ ID NO: 400 - DNA, 813 bp, Pinus radiata
ccttcagacaacccaggagcccatatcgaggagagcaatcgcagttgcatttcaactaccccaatgccaaatattgaacattaaaacgcgtaaagtgcagggtgagctcattctgtgtaacccaacagcggtacttaacaatgacgaatacctgtaatctaccgcacttcatctctatcgtcatcttcctcgtcctgctgttgaacgttgttaattgcaaaactctcaaaagagatgtgaaagcattgaacgagatcaaggcatctcttggatggaaagtggtgtacgcatgggttggagatgatccgtgtggagatggagagttatcaccttggagtggggttacttgttctcatgcaaaccaaggagagtaccgtgttgtcacagaattggagctttatggagtgtcaattgttggtccttttccagtggcagtaacaagtcttctggacctgagaagattggatcttcatggcaataagctgactggttcaatacctcctcaaattgggcgactcaagcacctaatgatattaaatttacggtggaataagttgcaagattcaattccacctgaaattggagagctgaagaaactcacgaatttgtatttgagtttcaacaacttacgaggatcaattccaaaagaacttgggaatttgccagagcttcgctatctctaccttcatgaaaatcgactcacaggacgaattcctccagaactgggaattcttcccaaccttcgtcacttagatgttggcaataatcacctggtagggactatagagaggctcatccgtaaggagggtgctt

SEQ ID NO: 401 - DNA, 539 bp, Pinus radiata
ggaaaaaagcttcgaatggtgggttactcttgcagaggaggacgagagtgaagagcccaagaagaaggagaaatcgaagagcagagagcgcagggaatggtggagggaagaattttgcgaagaattgagccagaagagcaaccgtagcagtagacgagttaatagccgaagcagaagcagagactggtttcgcgatgaacctcttcccctgcaccaccatagcagggattggggtagcggagatgtgatgagaagcggagtgagtagcacaccgagcatgcgaggcaccgtttgctacgttgctcccgagtatggcggtggcggtgcgctctcagagaggggcgatgtttacagttttggggttcttctgttggtaattatctccggccggaggcctctgcaggttatggcgtctccgatgacacatttcgagagagcgaatctcatatcgtgggccagacacttggctcgttcgggcaacgtcttggacctcgtggacgccacgcttggtgaggactacgataaaacccaggctctgc

SEQ ID NO: 402 - DNA, 576 bp, Pinus radiata
gttttatgtgagaagaatgttcttgggcagggaggtgggtggcaaagtatataaaggagtactggcagacaatatcaaaggttgcagtaaaacggttcgactgactatcatagcgctggtggggagcaagcatttctacgggaggttgacgatgatcagtgtggcagtccaccgcaacctctttgcgcttgataggatattgtgttgcaccatcagagccgaggccaatccatacatacaaaaaaaaactgaggcatacagacaaacgaagcgaaaacaaacagaaaaaaaagcaaacagaccggcccgcaaaaaaaaagccggacgtacagccagcccgtgggaggaactacatgaacaagcaaagcaaaaaaaaaatcatccagagggaaaagaaaccaacgaatggctagatgaagaccttgaagctgttgttggtgattttgggctagcgaaattggttgatgctaggaaaactcatgttacaactcaagtccgtggaaccatgggtcacattgctcctgaatacttatcaactggaagatcctcagagaggacagatgtgtttggttatgg

SEQ ID NO: 403 - DNA, 448 bp, Pinus radiata
atcagtacaagttctgaggcatgtaaccaggaatttcagccccgaaaatgagcttggaagaggtgggtttggggttgtatacaaggggcagctagatgatggcactataattgcagttaaaaggatggaggcggcagttgtaagtaacaagggtttggcggagttccagtcagaaatagcggttttgtcaaaagttaggcataggcacctggttgccttgttgggttactgcatcgaaggcaatgaaaggcttttggtatatgaatacatgccaaagggtgctcttagcaggcatatatttgattgggccacgaatgggctggaaccaatttcatggaagagacgcctcagtatagctctggatgttgcgcgaggaatggagtatctgcataacctggcccacagaagctttattcatagagaccttaaaccatctaatatacttctt

SEQ ID NO: 404 - DNA, 437 bp, Pinus radiata
tgaaggcactcactgaattgggcatatttaatactagtgtttctggcactattcctggaagtatcagtggtttagtttcgcttcgaaggttagatttatctggaaaccgccttaagggaccaattccggatggtattggtagatgtgttgcactagagcacttagtattgtcaaataacaagttgaatggaacgttgccctcgtctctaagtaattgtacttctttgcaaagattgaaggtgtcagataacttgctcagtggaggtttggatatcagatttccagtttctatggaagttttttctgctcattctaataacttttatgggaccttaccagcatctttggccaagtgtactaaacttcaattgttagatgtaaggcataatggattgacaggtgagcttccttattatcttgcctattttgatcagtta

SEQ ID NO: 405 - DNA, 435 bp, Pinus radiata
gtttctctcgtacaaccaattctctggtccgctgccttcatctgtttcacttttagatcggctctggagattggatgtttcaaacaataatttaactggcgagataccattttcattgaatttgcttagccatttgctcactctgagactggaaaacaatctattttctggtactatcgcagccttgaacatgaccagtcttcaagacttcaatgtttctggtaatcagctcacaggggccatccctggatctttgtccaagtttcctgattcggcatttgaaaagaatttatttctttgtggcaatcccttgccaagttgcaagagcataatcactaatcctaccactccaggaggcattgtgaattccagccctgtgacgcaggatccaagtattgtgccctcgactccaagttcaaagcctgagatggcaca

SEQ ID NO: 406 - DNA, 551 bp, Pinus radiata
ataacaggtttcatcttgaaatcccttctaatcttggaaattctcctgtttctgttgttgttttcgccaacaataatctcaaaggatgcgttcctcccagtctgggaaaaatggctgccactcttaatgagatcatattcttgaataataatctgtcagcctgcctgccatctgagattggcttgctgaaaaacctgactgtctttgatgcgagtttcaataagctagttgggcctctgccagacagcattgggcagatggacagcttggaacaattggatgttgcccacaatatgttaactggaaagatcccccagagcatctgtgcattgcccaatttggataattttacttattcctacaacttctttactggggaggcacccaattgcctggcccttcctagcagaggcgttacctttgatgacaagagaaattgtatccccagcaggcctcttcagagaacactccaacaatgttccgcgttcctgtctcggcctggcgtaaattgctctgcatcctcctgtaatcctcggaggattttcccatct

SEQ ID NO: 407 - DNA, 265 bp, Pinus radiata
ggtgacaatcatagggagaattcatcatctcaacctggttcgcatgtggggtttctgcacagaaggtgaacacagactgcttgtgtacgagtacataccaaatgggtcattagacaaatatttgttcgataagcagggcaagggcgaaacagttgggttggactggagctcacgatatcgaatagcagtgggagtagcaagagccatagcgtacttgcacgaagaatgctccgaatgggttctccatcgtgacatcaaacctgag

SEQ ID NO: 408 - DNA, 690 bp, Pinus radiata
cctacttgtcattgtgtttgttttctttgtccttaaacatgagagaagggttgccgttggacacacagaaagggatgtaaatcctccagttcgcagaggaggccaatcagtagttggaatttcagtgagtttgtcaagcctcggagagtctttctcttatgagcagttgcttcaagctacggaagagtttaatgcttctaatctcataaaacatggccactcaggagatctctatcaagggttgttggaaggtggtgttcctattgttgtaaaaaggattgatttaaaatcattcagaagagatggatatcttgcagagttagatatatttgggagggcttcacacacaaggttagtgcctcttttaggtcattgtctggaacatgaagatgagaagcttcttgtgtacaaatacatgccaaacagagatctttcttatgccctttacaaaaagggctgctcacctgaagatactttacagtcactggattggataacacgtctcaagatagcaattggagcagctgaaggtctctcatttctccatcacgagtgctcaccaccccttgttcacagggatgttcaggcaagtagcatccttttggatgacaagtttgaagtacggcttggaagcctgagtgaagtctgtccacaagaaggagaggctcatcaaagtgtgatagctcggtt

SEQ ID NO: 409 - DNA, 518 bp, Pinus radiata
gaaaactagcagattttggcctttcaaggatgggaattgagggggaagcttcttatgttaccactacagtgaaaggaacattaggatacttggatccagagtattttagcacacaaatgttgaccgagaagagcgatatttatagttttggagttgttttgctggagattatttgcggtagacagcccgtagatgcaaaactatctgaagaggaaacaaaccttattcgatgggtcacaccgtatgtggagatggaagaaattcctcccaaattagcggaaatcgtagacaagaggttaggtaaagattacgacatcaaatccatcactgtcgttgccaaattagcgattcgatgtgttcaggcagtaccatcatccaggccgcgcgtcagtaaggtagtggcagagcttaaagaggctctcaaatttgagatggataaggattctctaatttcgaagactgatatcgaatatggagattttagtccagccagatctctttatccgtcattcgagtgg

SEQ ID NO: 410 - DNA, 410 bp, Pinus radiata
gttctggtggttttggaaccgtttacaagctagtgatggatgatggtaatgcctttgccttgaagagaattgagaagacgtctgtaggttctgatcgggtttttgagagggaacttgaaattcttggaagtgtcaaacatcgccatcttgtgaatttgcggggctattgtaatggtccttcggcaaatcttctaatatatgactttctagctggggggaacttggatgaaatgcttcatggaactcatgatcgacctcttgattgggacgctcgggtcaaaattgccattggagcagcaaagggtctggcatacttgcaccatgactgctcccctcgtatcatacatcgtgatatcaaatccagcaacatattgcttgacaggaacttggaatcccatgtacctgaattt

SEQ ID NO: 411 - DNA, 986 bp, Pinus radiata
ggacattttgttagtaccttggcggacggattcttttacaggtgaaattgggagcatgatccgggcctatagattgtactctctgatgaaagcggatgtttgtgaatcgtattcggttacattgctaaagcctcctctgcagcagattatacccaaaaaatcattggggtttcatgttgttgtatgggccctctgaaactccatggccttggagcaactaatgataaggatcagtgatgtggggacgaaataatggaactcctgagcattttctgcttttgtgaggtactaaaattctgtatgattccattgcgctgaaaccaagaactctgtctgtctgatcaggctgtatcatggcctacaagcttttgagattttggcttgaatttcaggccttactagtcctctttccattggctctgagtgtctctcaggagggcttggttttgctggaagtgaagaaagaactgagtgaccccaatggatttcttggtaactggaaggcagaggacgattctccctgcaaatggaggggtatctcatgcgaccagaggtcaaaatcggtggtggggattgacctaagcagcggaggtttagttggggtttttcctagtgtcgtttgcaatcttccacagctgaaaaatctgtcgttgggggataacaatattggctcaatattacctcgcaacctttccatgtgcaggcagcttcagcgcttgaatttatcgcagaatctttttgtggggaaccttccggactttatttcagagctcgcagagctggaatacttggatctctcgagtaacaatttctctggttcgattcctgcaggcattgggaaactgccaaggcttcaagtactgaacctgtgctgcaatctgctaaacgagacaatcccaacatttctgggaaatctcagcaatctgcagcaattattgctggcatacaatccctttgcccccggtgtgattcctccagagctgggg

SEQ ID NO: 412 - DNA, 543 bp, Pinus radiata
gagtggacatattcttcaagagctctctaaactatacagtctggctgttctggatgtttcatctaatagcctttgcgggccaatccccggaggaacacaattttccacattcagtgcaacatcatttcaaaggaataagtgcttatatgggtgtcctttagattcatgcagtgaaaaggaaaacccagtgggagaaggtgacaataatagtagcagtgcccatatgaaaatgggatggcttgagcatttagatgaaaagatgtcattaatggcattggggatcggttttggtattggaatttggggagtagttggtgtatttatcttttgcaacagagctagacactgggtgttgggtctaccacctaacaaaccacaactcttctatggaatggatcgattccctacataaagaaccaagtaatggatgttggctctagtatgtggtgaattaaattgtcatgtaatctaccaatgatatttttggtatactatcttatcacatatataaattttagtgtgatcaaaaaaaaaaaaaaaaaa

SEQ ID NO: 413 - DNA, 1033 bp, Pinus radiata
ggcacgagatagagtgagaaatacagagcctaatctgaaggaagttggagtgatagagtgagaaatggatcttcttcttctcctgcttgtgatgatgggtgtagcaatgcctactcattctcaacacacgggtggattcacttctgttcaacgttttccttttaatggacggagtatgatggggaaaccctccatagccgggtatcatgaaaaaagggatgtggaggcacttctcagcttccggaagggcatcacattggatccatatggatggctctccaactggacggccaataactcacataacgtctgcctgtggaacggaatttcgtgcagcccaaacacgaatcgagtggttgaaatttctctccgttacggccggttgaatggtacgctctccccgtatattgggaacctctctcttttgcggcatttagatctttcttcgaatgctttgagtgggagaattccagcagagtttgggcagctgaaagcgctacgaatacttgacctctccaataatgctttgaccgggagtataccaacttgtatcggcaacggcgggttgaatggtacgctggatttagatctttcctggaatgctttcagtggaagaattccaaaggaattgtttaattgtacacgtcttcaacggatcgacctttcccataatagtttgacagggagtataccaacttctatcggcaactgcgctttgctccaaacgttgaatactggattcaactatttgagtggaagcatcccaacttctctcgccaactgcacttcacttacagatttggttattagctccaacaatttgagtggtccaataccatcagaattcagtggcctggtcagcttgaaatttctcttcctcgacgacaatagtataagtggaagcatcccaacttctctggtcaactgcacttcgctctttgccttaaagggcagcggaaacaaattgagtggtccaatcccttccgttatgggtttgatgaaaagcatatctactattgatttatccaacaac

SEQ ID NO: 414 - DNA, 758 bp, Pinus radiata
ccaatttcagacagaagttgagatgatcagcctggctgtgcataggaatttgttgagattatgtggattttgcatgacatccacagaaagactattggtttatccatacatgctgaacggaagtgttgcatctcgtctgagagattccatcaatggaaaacctgcattggattggcctacaaggaagaggatatccctgggagctgctaggggacttctgtacctacatgagcagtgtgatcccaagataattcaccgtgatgtaaaagcagccaacatcttactggatgaatattttgaagctgttgtgggtgactttggattagcaaaacttctggatcacagggattcacatgtgactacagctgttaggggtactgttgggcacatagcacctgagtacctctcaacgggccagtcctctgagaagaccgatgtatttggttttggcatattattattggaactcataactgggcaaaaggctttggattttggtcgggcagcaaaccagaaaggagtgatgcttgattgggtaagtacaattgaattctgaatgctattatgaataccaagtaagaaggattttaggtaagaatacagtcttgaattatgcggttgtcttctgatacttgtgtgacaggttaaaaaactacatcaggagaataggctcgaaatcatgatagacaaggatattaaacccaattatgacagagtttgaacttgaggagatggtgcaggtagcactgttatgtact

SEQ ID NO: 415 - DNA, 499 bp, Pinus radiata
gtttttctcatgctgctgtgctttgtgctcgttgcagggacctctgctgctgtagacgatcatcaatatctgtatcatccttctcattatgttatgaatgagcgccaggaatctggaagctccatggcccgccacgagaaaagggatgtggaagctcttctctccttcagaaacgccataacggccgacccacatggattgttgtccaactggacggcccacaactctgccaacatatgctcgtggaatgggatcggctgcagaaaacagagcagaagagttgtttccatataccttcgtttctcacacctagaagggacgctttcgccttctgtgggtaatatctctttactgcacaccttcgtacttactgtcaataaattgacagggagaattccgccagagtttgggcaacttaaagccctccaaacgcttgacttgtaccgtaatcttttatcaagttctggtccaggagaattggggttgctacagaaacttg

SEQ ID NO: 416 - DNA, 496 bp, Pinus radiata
cattccttctcttctcgtttgtgcaatgagaatgtttctattactcgtttatttgttcccccttgtcactcccttcgcgttttccacagtgcaattatctaatggctctaatgctgtcgatcaagaggctgtgcttggattcctgtctgcaatcactaatgatccctaccaatcgttacccactaactggaaatcaaatgtttcagtctgcgagtggacaattatcaaatgcaatgggtccagagtggtgtccctaaatgtgtcgagcatgggattagaaggtacaatctctcctcttctcggcaatctctcatttctggaaaaactcgaccttcgcaataacaattttcatggtcccattccctatcaattgggaagcctggtgcgcttgcagatgcttatcctcagtagcaataaactccaaggttccattcctcctactctgagtgggtgtcgcaatttaaggttcttgtatctgtctgctaacaatctcaga

SEQ ID NO: 417 - DNA, 534 bp, Pinus radiata
ggcagttggagtggtagagtgagaaatacacagcctaatctgaaggaagttcgagtaatagactgagaaatggatcttcttcttctcctcatcatgatgcttgtgatgatgggtgtagcaatgcctactcattctcaacgttttccctttaatggacggagtatgatggggaaaccctctctcttcccatcctccatagccgggtatcatgaaaaaagggatgtggaggcacttctgaccttccggaagggcatcacattcgatccacatgaatggctctccaactggacggccaataactcacataacgtctgcctgtggaacggaatttcgtgcaggccaaacacgaaacgagtggtttcaatttctctccctcagcgctcgttgaatggtacgctctccccgtatattgggaacctctctcttttgcagcaattagatctttcctttaatgctttgagtgggagaattccagcagagtttgggcagctgaaagcgctacgaacatttgaagtccgccataatgctttgagt

SEQ ID NO: 418 - DNA, 879 bp, Pinus radiata
aagtgacttcagtaattgccgccacattttcttgcagcttaataagcccaagcagagggactcacggagtgattcagtgctttttagagtcgatgatgacagtgtctgccattcccggcgtgtgctggcaaacagagaactgttccggccagttatggaacatgacggcatagcgctttagccttaaatgctgtttggctcttaaagaacgtggaagcttgcggttttcgtagagcttgtgctattttggtgctgtgaaaccgagagagatgaggagatcagaggcttgaggtaggagaagcgtgtgttgtctttgcttgcgtgtagcctgcattgaagtggaaaacttgaagccgtggacgtgaaaatgtcacgggctggttacctgcattttctgtttttctgttttgttctgacagtaagaagctgcttcgctattcgcggttggcaggacgggcttattttgcaagaattgaagcgcggattcgatgatccgtcaggagcgttcagaaactggaatgagaatgataattctccgtgtaattggacgggaattacgtgcgatgccggcgaaaagttcgtagaagaagtcgatctttcgagcaagaacatcataggaccgtttcccactgttgtttgcagaatcgatggcctcaagaagctctctttggccaataattacgtcaatggttcaattcctgcgggcttgagaagatgccacggcctggagtatttggatttatcgcaaaatcttatcatcggcgggcttccggatttcatctccgagctcttcaggcttaagcatctggatctttctggaaataacttaagcggtccggttccccctgcgttcggccggctgccggaattgcaagtctt

SEQ ID NO: 419 - DNA, 760 bp, Pinus radiata
attctcgaagccgttcttgagccccgaaagccaaagccaaagccaaagtccaagcccaaagtcttttgtttatttcaaagtctgagaatgaaggtccggtatggatcctggatcgtattattgttctttatcagttgtgtttactctgcagacgaagatgtcgaaatggatggaaagtgcgtggaagcagatctggcggccctggtgagctttaaatttcacatcgtcgaagacaaatccgagatctttaattcatggagcggtaaccattgctgcgctggctgggaaggcgtagaatgcgatttccagaacgggcgcgtcgtgaagctggagttacagaaccacgaatcgagtaacgacactatgtacatgcgcggaactctgtctccttccctgggaaacctcgctttcctccaagtcctggtaatcaatggattcaaggagatcaagggatcgattcccgccacgatcggaaatatttcacatatcaagcagctttatctcgagaacaataagctctccggcctaattcctccgtccatcggaaaattatcgcagctcgagacgctttccctcaacggcaaccgtctcagcggccgaattcccgattccatgggcaatctgcagcgcttaatacagctcaatcttgccaaaaatcgcttgtcaggcaccattccgccgtcgataaagaatctcggcagcttgctgttcttggatttgaatgataatcttctttccggtcccgtcccggcattcttag

SEQ ID NO: 420 - DNA, 859 bp, Pinus radiata
aaaaagagaagcaatggattcttggagaaaaaattatgccctgcctgtttctctgaaaccttgtgtcagcagcctcactgttatggtcatcttctcccttgttataccagtttttcctaccacgtttgtattcaacgaattcaatggaaccaacttgatcttggaggcaggtgctacactcattccctcccgatctgcggtggccctcacaaatcacacgcactgggtgatcggccgggcgctgtattcaactcccgtgcagatgaaaagcaacgggacactttcctccttcagcactacctttgttttcagcatggtgaatccccaccttgacgctggcggtcacggaatagccttcttcattgcacccaacacaactctcatggccggtctggcatcggagtatataggcttggttaacggtaccaacaacgggcaggcgtacaatcacttgttcgctgtggagttcgatacgacgaggagcgtggaattgggggatcccaatgacaatcacgtgggcgtggacatcaacagcctcatctcggtgaagaccgcaaatgctggatattggaatgcggaggaattccaaggaatcaatctccagtgcggaagcaatatacaggcctggatcgattacgattctctgcagagccaggttaacgttaccataacgttggctggcttgccaagaccgcagaagccgcttatatcacagaaaatcgatctgcagaacgttctgcaagagaatatgttcgttggcttttcggcggctacgggaaatctcgttgaagaccattacgttttggcgtggagcttcaccacagaaggcacggcgtcaccactcgatatctcgcgtctc

SEQ ID NO: 421 - DNA, 498 bp, Pinus radiata
ggagtggtagagtcagaaatggatcttcttctgctcctcgtcatgatgtttgtgtgctctgtgatgatgggtgtagcaatgcctacggatggattcacttctgttgaaagcgttccttttaatggacggaatcgccataaaagggatgtggaggcgcttctgagcttcaaagagagtattatatccgatccatatggatcgctcaccaactggacggccaataactcacataacgtctgcctgtggaacggaatttcgtgcaggccaaacacgaaacgagtggtttcaatttctctccctgagtgctggttgaatggtacgctctccccgtatattgggaacctctctcttttgcggcatttagatctttcttggaatgctttgagtgggagaattccagcagagtttgggcagctgaaagcgctacgaatacttgacctctctgctagtcatgggctcctccacggctatattccaaaggaattgtttaattgtaca

SEQ ID NO: 422 - DNA, 470 bp, Pinus radiata
ttctgcaaatcaagaatgggatcgtcggcctccccttttatggtgttgttactcctttccactttgattcttgaaatattgccaatgtatgttgcaacaaatagaagcgaagctgatctccaaggtctcatagcattcaaggcatcaatcaccagtgaccccttgaatgctttagctgattggactgcttctgctcatcactgtaattggtccggtgtggcctgcgatcccctccacaacgttatctccattagcttaccagagacacaaatccaaggcctcatctctccgtttcttgcaaatatatcttatttggcttcactagacctcaggtccaacttcttccatggtgtcattcctccgcagctcgctctgtgctcccaacttatcgatctggagctctttaacaattctttgacaggtatcaagcttatcgataccgtcgacctcgagggggggcccggtaccca

SEQ ID NO: 423 - DNA, 468 bp, Pinus radiata
gtggatccaaacaattcggcacgagtcgacttcttcttattctcgggatggatccagaaaactgaaattggctgccggtctaattgcaggtgcagcaatgttaatatccgccattggactgatacttttccggcggttccttcaataccaggcagattcactggagaaaaaggaaaatccatcatggagacttatagcttttcataacttgagcttcgatgtggaagatatttccagggtttgtttactgaaagagatgaaaatgtgattgggagcggagcatccggtaaggtttatcgcgttgacatacccaacaatgaaactgtagcagtgaagcatctgtggacatccaccaaaatggatatggacgatatctaccatggacaaaaataagaagaattcctacaattcctacaataacaaaaatgtgaacatttacagagaccatgaccatcgcttggcaaaggc

SEQ ID NO: 424 - DNA, 678 bp, Pinus radiata
ctctgttaaggtaccatatcctaatcatgcgtaagaggcttcgagatcgagttccgttactgaaaaatggcgaaggaaacagtcaaggttggctttagattgactgcagtggcatgtatttgtgtgtggacgagcatttacacagcattttcacagaatgcagagccgttggccatccggatcagctgcggttcatgggagaacacacatacccccgacacgaatatgctctgggtaaaagactacggttacactggcggctcgtccgcaaacgccaccaccacgagctacatcgctcctcagctcaagaaactccgtttctttaagctctcggacggtcccgagaactgctacaacgtcactcgtctaccgaacggccattattccgttagaatgttctttggcctcaacgaggacgttttggccgaccgcgagccgctctttgacgtctccattgaaggaacccaggtctattccttaaagccgggctggagcatgaacgacgaccaggcatatgtcgaagcttcagtctttgtcttggacactgctgccactgtctgctttcacagcaccggccacggtgatccttcggtaatgagcatcgagattcttcagcttcatccacaagcttatgattttggggctcagtggggggatactgtcatattcaggactgct

SEQ ID NO: 425 - DNA, 494 bp, Pinus radiata
aagatgatgagcttctgcaatttatgagagtcgcatgtgcttgtgtgctgtctgggcccaaggaaaggccttcaatgtatgaggtctatcatttgctaagggcaattggtgagaagtacaacttctcagatgagaatgatgagattctattggcatcaggaactgctgacaacgactattcaaatgagcttatagtgtctagagaataaagctcgtatataatcaagatcattccttgggaaagtctctactagaaataactgataaaaatgagaacacggggtgatactcttttttgggtacataggaacaagcaaggtatgaatttctatgtgacattcagacattctataggtagccatttatgataactttgttgtagtaaattagatcttcaggttataaacatcttgtattggatttaaggcctttaggttattttctaccatcaattcagtatttaatcactcttatcctaaaaaaaaaaaaaaaaa

SEQ ID NO: 426 - DNA, 483 bp, Pinus radiata
gtctaagattaagaaataaatctcgcttgggactgcagccacttgttacataattagcttttgtatgtaaattcaattcattcggctacactttcgtcttctatgaatcagtggccatctgtctaaagctttggttccagcctgccatttgaactttctaaaatccctgtgagcatggacaaaattccttatggcgaatggtctcgctggatcgcctttggctcgtttttactggttgttaatgttatttctgaaccagagggatttttgagtatcacttgcggaggggaaatgaatacaacccacaacggcataacatgggtcggggatgctcattacatagacgtgggtaacacggctgagataacggacctctctgaaaacgcttacggttcttacttacacactatacgggttttcccaaagcctctcaacaaatcttgttatcagttgcctgtggttccagatgtgccatacctctta

SEQ ID NO: 427 - DNA, 473 bp, Pinus radiata
cactttaataggtgacagagtactggacagacgatggagggaggagaacttggtgtggcgttgaatgtggttcggcaattgatcgaagattaggcaatgctggctgatactcagaatactcggaatactctgaactctgttgtttctcattgccactgtgtgtatctgcagccatggcatttgcctctgacatttggcgctggagaaaactcagtgtgtgtctgtcttccttagttacatttctttacttcttcggccttctatctgctgtttctgatgatggagcaactctcttggcaattaagaagtcgtttcgtgatagtgataacgttctatacaactggattgattctgcttccagtgatcactgctcctggaggggtgtcacctgtgacaatgtcacctttgctgtggttgcattgaatctctctcatctgaacctcggaggagaaatttccccagtgattggaaat

SEQ ID NO: 428 - DNA, 455 bp, Pinus radiata
gcttggaaatagtttcaaaatagagtctatatggaagattgcagaagttgcgattcttagtgttgagccatctggatcgttgcggccaagaatgcatggcgtacttcaggcaattcaagaggccattgaaattgagagaggaaatgaaactgcagaggaaggggttccaggatcattggcaggacattcaatgcaatctgttctctcaagcactcatgaaaatgcaggttctgatgcttctttctcacattccaatcggcagctattgcctactgtcagatgaagaggttgcattccttttgtaggtgtaatcttattcacttggcatttcaattgccaaagagaatggcagtgccatgtgttggaatctctcatctagcaaattcactaccatgtcttctatgaaagtcaaacttcaaaatgtggttcctgtagattgggccaaatagattgcc

SEQ ID NO: 429 - DNA, 390 bp, Pinus radiata
gggaatttaacaaacctcagaagcctcaatctttctggcaatgaactcgaaggccctgttcctccagttggcatcttgaaaagtttcaattcctccagttttggagtgctgcattcccaacatcgtccacggcataccatcacagttgtggttatttcagttattgtaagtgcaataatctctttactgttttgcattgcatttattctttgttacagggtcagaagaaaaaataatatcaattctgaggaactgccgatcagcatgcctggagagccattgatccagagatttacaaaaagggatttggagatggccaccgagtcattcagtgctggtaatataatcggaagcagctctatcagcactgtgtaccgaggtgtactgaga

SEQ ID NO: 430 - DNA, 375 bp, Pinus radiata
gtcgagtcgggagaaatggatcacagtgctcctcttcttcttctcatattattgtctctctgtttgctcgtctctgtgtctgctgcgctgtctattaattactcaacctccaagccatattcccatacccatgcccatcaatatctgtatgaccccattcctggtggattaacttcacttcaacgccattccgattctgaacgcatggtagaagaagctgatttcaatttatcagcaatagacacccacgagaaaagggacctccatgctctcttgtcgttccggaaggtcatcacgtcggatccaatggagaagctatccaactggacggccgacaactctgagaatatatgctcctggtctggcattcgctgc

SEQ ID NO: 431 - DNA, 354 bp, Pinus radiata
ttccagtcgagctgggcctgatgcagaatttggagcagctacttctggacggcaactatctctcaggaaatctgccaggacagctgggtaatttgacacagcttacacatctatcgctttcaagtcctaatatttatggttctattccttatgaaatatttcggctgcccctctcctacctctctcttacctttgaccacacagggagcatatctaaagccattgctaatttgactaaattgacccacttagctcttcctcaaatgggactcactaccataaccgaagacattgccaatttgactgagttgaactacttagacctttcctataataggctaagagtacccatat

SEQ ID NO: 432 - DNA, 264 bp, Pinus radiata
ggaaggcggggccgccgaggacgactcctccaccgacaaattagtggttctgctaaacgtggcggtctcttgcgtggcgctgtcgccggatgagaggcccacgatcgaagaggttttgacagtgttggaggaggatgccatagagtcgcacagctgtcctggggattttcatggcagctctattccaacagaggagcaaggaatgggggacaacaccagtgaacgaagctggtcagagccggagtaatttattattattattat

SEQ ID NO: 433 - DNA, 554 bp, Pinus radiata
aatgtgtcccgaggagcaagtcctgagatgcattcacattggtctcttgtgtgcccaggctgatgcaacagtaaggccacccatgtcttccatatttttgatgctttcatcgaattctatcgcgttgcccacccccaccatacctggctttgtgcgcgttacccagacagaggaaagtttggctttcaatcggaaggatgtggcagcactgtcaaggacgtcggcagcatcatcatcaacatcttcccacagtcctctcgttccttcttccagaaatgacgtttccattactcaggtggaaggcagataatcatcttcaccgagcaaatggagcccaattcaaaagatcacaattcctttttgaattccatgtgcagaaattaccagctcatgtttcctgtaatctatttggcattgcatttgactgtgaatcatagcatcacgaagattttctcctttctccttactcatccttcatatgtaactctgccctgtagctcatagtgtgctattgtgagtaatataaatcatttttctattgccaaaaaaaaaaa

SEQ ID NO: 434 - DNA, 475 bp, Pinus radiata
gcaaccatgagggagagagagaccaaggtctgtatcttcattttctgtattttcacatcatgggctctggtcgattttggggttcctgcagtttttgcagcacaagagactcagatacaaatactcctgaggatgaaagaggctctggaggatcccacaaatgcactcagggattgggatgggtctgaggattctccatgtagatggagagggattgattgtaacgatgaaggtgctgtgactcgcatacaactccatggaagttctctgagtggtcgcattctgcctgatatctgcaatctccagagcctgataatctttgagctagatcgaaattccctttatgggaatttccctccagaattttcgaattgcagtcggttggaacaattgaatttgagctccaatttgctgaacgggtcattgcccgacctttcaaaattgaaggctctgaaatatctggacctgtctaaca

SEQ ID NO: 435 - DNA, 528 bp, Pinus radiata
gcttctcttgctttttgcctccaaatcttcgcttgcattgggaattttcccatggcacctcattcccagctcgatgccttgaaaaagaacaatgaaaagcttccgaccagagcctttgagatgtagccttataaacaaatatttgcaagtacgggagcgtttcaagatctgttgtcttgcaaaggtgaatcagaaaaatgggctcttgggagcagtccacagtgccgagcattgcatggaagctattcatcattgtgctgctgctgattttagtggaagatcatgcagtggttggtgacaatgcttctgataaaaaggccctcttggctttcaaggcagcggttgggaagcgtctgaactggtctcagtccacaaatccgtgcaccccctggttcggaattacgtgtgtaggatccagtgtgacagaggtgagacttcctggacggtctctgtttgggtcaatcccatcgggaattctgggaaacttgagcgagttaagagtattgagcttgagatacaactcgctca

SEQ ID NO: 436 - DNA, 773 bp, Pinus radiata
ggcatagtcctctgtactcaatccatcaaattccatagctttgcagatattgcagggtttttcaataatggcgaacagacatcaaatcctgttactcctttcttcgtttcttcttcttgtggctgttagaacccaagctcaggactcacagcccaatatcacaggctatgcctgttccagcgccccatcgccatgtaaaacatatgctttttacaaagcccaagctcctgattttcttaatctgcgaaatatcagtgatttatttggggcagtacaaagttcccatatagcaaacgctagtggcctgcctgctgatacatcgtcaatagctgatgggcaacctttgctcgttcctataacctgtggatgcatgaagaactactcgcaggccaatatctcttacacaatagtgaaggacgatactttttatggggtttcaactaggaaatttgagaatttgacaacataccaagctgtagaggttgcaaaccctaccctggtacccacagacattcaaattgggagtcttgtcacgtttccaatcagatgccaatgcccatcaaaagctcaactgggaagtgggaccaagatgctgataacatacgttgtggagaagggagattctctgtcaagtatcagcaagaagtttggagcagagcagcagaatttgaaatctcagaatggtaagaattcaaccctagatccttattctacaattttggttcccctttccaaattgcctaagcttgctcaagttcttcaccatccccatc

SEQ ID NO: 437 - DNA, 500 bp, Pinus radiata
ctctcctcgtctctgcatttcaagcaccatggcgtttccatgtttttattttcctttccgtatcttgtttttcctcttcgtatgctctttttccttctccttctccttctctgcgcacaaatttcatgacggtcggaaatggctcttgtcattcaagatcgatattaccaatgatcctcatgcttccatggccaactggagtcctgcagtccacctgtgcaactggactgccgttacgtgcagtcgcaggcacgcagatagggtggtctctctcgacctaagtggcatggatctgagcggctccatatctccttccctcggcaatttgtcatttcttcatacccttaatctcagtgccaatgctctccatggtcatattccaccacaactgggacgcctctttcgtttgagaaacctctggttacgcaacaattttctgcaaggaaatatccctacagagttcgcctccctcaaacatttgcaacagctttacttggggt

SEQ ID NO: 438 - DNA, 471 bp, Pinus radiata
gttcgctgagagctgtagagtgatagtagtagtagcacagcttcgatgggtggcctgctgatttgactgtgttggcagttgcagtttttctgatggtttctctgagccagtgtgggtttagctgaacgatgaagtgctgggactcatagttttcaaggcagatttgcacgatccaaaacatccctggcttcttggaacgaggacgataacagcccatgttcgtgggcaggtgttgtagcagcgccaaaacaggaagagtcacagaagtggtgctcgacaatctctctttatctggaagatcggcagaggtctcactaggctcccgtcccttcacacgctctcacttgccaacaacatttctctggcgatatcaatatcagtgcagatctggcccagattcccagcctcaggatctgaattttgaatcacaatgcgttctctggtgcaattcctgcagagctctttcacaat

SEQ ID NO: 439 - DNA, 662 bp, Pinus radiata
ttttttttttgagtctttgaagagttgggcgatctgagaatagagagaatgggcagggctcgggttcgaccctcgcccgcggcgaccctggcattgtttctgggtgccatgagcttcttgtgggcgaccccgcatccactgagcaatggcttcatccccgcggatgacatacatttaagctgcggtgcctcaggcaaccagaaggactcagacgggcggacttgggtgaccgacaagggctccaaatttgctccgcctgacttatccaattttctctcagagaccgcctcctcacagagcccttcactcccctcaacagtcccttacatgaccgcacggatcttcaaagccccggccacatattccatcgccgtttcgccggggcaacactggttgaggctgtacttctacccgtccaactatggatcctaccaggctaccgacgcgctcttcaatgttgaggctaattcctacacgcttcttcacaacttcagctcttggcagacggccaacgtcctgaacatggtctcgttgctctatgaatactccatcaacgtgacctccaacaagttgaacatcacattttcaccagagaacccgagttcatacgccttcgtcaatggcatcgaggtcgaatcgatgcccaatctcttcgatgtaaa

SEQ ID NO: 440 - DNA, 639 bp, Pinus radiata
ctcagtttaaccctgctcatcgtccgaagatgtctgaagtggttaggatgttggaaggtgatggattggcagaaaggtgggaagcttcacagaaggttgaaacacctaaatacaaggggatggaaattatatccaagaggtattctgactttatcgatgaagattcatcactggtcttgaaagcaatggaactttcaggtccgaggtgacttttgaaatgttaatctcgtgtttggaattttgctcctgtgaaacgctggaggcttgtttatcttggagcatctcgaattagcccccaggcagagttggttgttgtagcttccttgcagtttcgctgtgaggtgcactatgatggcatcactgttttgggtgttttcttgtaaaataattgtagtatactctctgatctcacctccaggtacatttccaacattgtttttctgcatcaaaatgaggaatataagcacaacttgtatgtaacttgtcagactgagtcgatggatttctgctgagattacctgcaaattctagaaattttaccacagtcagggccagtttttgattttgagttggcaaagcactgggcttagatgttactccatgcttattaggctcgtatatgcacactgtggctggcct

SEQ ID NO: 441 - DNA, 434 bp, Pinus radiata
gacgcatcgccacaacaatgctctagctgtgcacaggaagcgacgatcacagttcaacagctttgcgagaatgacataggcggccgagtgtggttcgatgtgtgtttcttgcggtatgataatttcagtttcttttcagtcttagatgcccgtgtcttttctattctccgcaattcccagactgtgaaggacaatccggctggttttcagaatgacgtcaaggatctacttggttctctgacggatgaaaattccgatctcgtgagcaagggattagctgtacaattcgctgcgtcatctttctctggaacgggcagggtttttggtttggtggaatgctggagagatttgcccatagaagactgcaaatcatgtttgttaatagcgctcaaaaagctctatccttttatggtaaaagaagggggcgaagcgtt

SEQ ID NO: 442 - DNA, 366 bp, Pinus radiata
tcttggccaattgtaccaatctttttatactggatttagggaataatagattcactggtgagcttccttcataccttgcaaaatttagtaagttgagtatttttagtgtcagttataataatctccatggtacgattcctcaatggattacaaatttcacctcattgtttttgttggatttatccaacaataagttcagcgggagaataccttctcatcttgagagacttcaaggatttacaacagattattttgcacaacacactcgaggagtttatccaattgaaatgaaagttgacataaaaggatttgagtacaatctgacatatgtattgcttacaaacagaatatttgatttgtcaatga

SEQ ID NO: 443 - DNA, 489 bp, Pinus radiata
tggatccaaagcatcataggcagctgcatcggtggcctggctgtgctagtagctgcaacagcaatgttggtaggatttctgttgaagaggaaaagagagtttgccctggctaccaagaatgcttgtgatgattcagagtttgatcgggcagaaatgggtgatttgccaattttcagctacaaagaactggaacaggctactaattatttcgatgaaaagagggaattaggcggtgggggttacggtaaggtctatttggggaaactccgggatgggcgcaatgttgcagtgaagagattccatgagaataactgtgacagattcaagcaatttgtcaatgaagtcaaaattctgtcatcggtacgccattgtaacttggttcgcctctttggctgctgtaaggaacgggagaatctgctacttgtttgcgaatatgtgccaaatgggaccttgttcgatcatcttcatggggcacagagagggaaaaag

SEQ ID NO: 444 - DNA, 516 bp, Pinus radiata
gcaacgcaggtcaacagtggaaacgccatggatctgcttgacaagaaattgatgaacattgcagacgcggagcaggtgaggagggctgccatcgtcggaggatggtgcatacaggatgacgaagatgcgaggccatctatgagtgaagtgctgcagatattggaaggcattacggacgtaccccctctgcctcctcttccgttatctctgcagaacattgcattaaaacccaacagtatcctccgtttcttctgggaaacagaaccttctgcacatgaacgcaacgacagtgataatccttccactacgctgtagaatctcaaagtattttctaacgcaacaacagtgataatccctccactacgctgtacaatctcaaagtattttctagtcgcttatattttcatctaaatattttctcagacttatccaagtccactacccgattatccgtaactttatagataggtgaaccgtgaagcagtttaaagttaaacgagtctgcatagatcttat

SEQ ID NO: 445 - DNA, 421 bp, Pinus radiata
cggacatggttctctgatcccacttcagcaaatttcatacttttgccatcgttgcagagctcttccaagatgggtaacagacaccagatgctgttacttctctcttcttttcttcttcttgttgctgttagaacagaggcccaggattcccaacccaatatcacaggctacacctgcaccaacagctcatcgacctgtgagacatatgttttttatagagcccaagctcccaattaccttgatctcctaaatatctctagtttattcggggtgcaaagagtccagatagcaaccaacagtaacttgtctactaccaccatctccgtagccgatgggcagtcattgcttattcctataacgtgtggatgcatggggaattactcgcaggcaaatatcacctacacaatctttcagggcgaca

SEQ ID NO: 446 - DNA, 377 bp, Pinus radiata
gttttcctttctcctgtaacaggggcgattcaaaatccattgaatctgttgcagagcttgaagctctggaagagccatggcctccaaaagtacctccacgctcactctcgctcttgttctttcgcagttcttatattcagctcagttgggagaagcgcgcacggtggccggggatgtggaggctctcaaagccctaaaggattcagtggatgcgaattctattcaagcaggatcgtgtctcagctcctggaatttttcagcagatccctgcgattctgcctttggcaagcttttcacctgtggcttgagatgcgatggagggagagtcacagaagtgactctggacgagtcgggatataacggtactctgccgcctg

SEQ ID NO: 447 - DNA, 301 bp, Pinus radiata
tccaaggaacagattctgctttctctcttgtcatgggccaaaccatgaagctattctacatcatcctgcttctcttcatcatcactgtttttcctgccaaagcagtcgaggaaagtgtgtgcaaccacgactttaactatacgaagggcagcaagtttgagagcaatctgaacagagtcttcaagagtcttgttcaacacacctctcaaactggttttaatacttctgtggatggccaaacatatggcctcctacaatgtaggggagacacaacagttgatcaatgtcacaactgttcaca

SEQ ID NO: 448 - DNA, 847 bp, Eucalyptus grandis
agccatggatagcaaaaacagtagtccgtggtcattcatactcccaattttcttgctttgctcatctctgtacacccacctctgtcttggcacagacaagctcgatgcgaatcgatctatatctggtaatcaaaccttaacctcatcgggtggcaactttacgcttggcttcttctcgccgggtaactccacgtactcctacataggcatctggtacaacaaaaacaaaatcagcgtgcaaaccgtcgtctgggtcgccaaccgagacaaccctgtcactgacaggcactccactggactgaaggtctcaggtggcaatcttgtgattgttaacaactccgaagtccctgtttggtccacgaatctgactgcttcttcatctggatcgagctccatggtggcggttcttgaggacgacggcaacttcgctctcaaagcggcgccgaattcttccgtgactctgtggcagagctttgattacccgacgcacacgtggcttcccggcgccaaattcgggatcgacaagcgcaaaaacacaagtcagcgcttgacatcatggaagaacgccgaggacccttcgacaggtttgttctctctcaatctccagccattcggtgagtactacatatggtggaataggtctaagcattactggactagtgggacgtgggacaatcagacgaaaattttctctttggtccctgaaatgagagcgaactatatttatgagttcaaatatgtggacaatgagaacgagagctacttcacctattcaatcaaaagctccttcaacaccatatcaaggtttgtgatggacctttctgggcagatcaagcaggagtcctgg

SEQ ID NO: 449 - DNA, 934 bp, Eucalyptus grandis
ctcatcagtcatcacatcccttggctgattcacaaagacttcgttgacctcaaaactccatagccacaaccttcttcctctcttctggctaagttcaatcaaactcattcttgagtcgaagaatttcatgtttgataactaaatgaatcctccatcgatgtcccctgtttcgattcatcataccctctttttcttgctgtttctaattccacgtccttctctagcccaagagaacataccagttggatcttctctaaccgccacgaatggcaactcttcttcatggctctctccttctggagactttgcattcggctttcactccttatccgacggcgacaccaagaaaaaccagctcttcttgcttgccatctggtacaacaagataccttctaaaacaatcgtctggttcgcaaatgaagaccgtcctgcccccgaaaattcgaagctaacacttgattctgattcgggtctcgtcctcaccaatccacagggtggagagctgtggaaacctgacaccgtcatcggcaccgtctcacacgctgtgctcaatgatacaggcaatttcattatcctggactccagttcagatgttaaatggcagagcttcgacaatccttgcgacacgttgcttccgtcgcaagtgctcggaaagggcaaaagtctctcctcccgtcaatcggaggagagcttttccagggggagattccaacttcggatgcgcgagagtggagacctcgtgcttaacactatcaacctgccttccgactatgccaacgaggcttattacagcaccgggacagacggcagctctaatgcgtccaccgcggggaaagaactcgtgttcagcaactcaggttccctgttcgtctcgagagcaaacggcgagaggttactcctctcgcaggggggcatatctcccgcgtctgattct

SEQ ID NO: 450 - DNA, 667 bp, Eucalyptus grandis
acggagagagagatgggatgcaggaaaatgcagctctttagtcctcaccacctccctctttccgctcattgaaaagtttcaagaacttggtccctttccatttcttgaaagagtttcttgttctttcccgttttcttgaaacatgcgagtgcgcagaaccctcctggtcgcgctcgccattgtcgcctcgttcttgttccccgttacggggcaagaccttgcttcggacaggaatgcgcttctcgccctgagatcctcgctcgctggccgcacgctcctctgggacgcgagccagcaaagcccctgttcttgggcaggcgtccaatgccagtccggccgtgtcacgtctcttccccttcccggagcttcgctctctggtcaaatccccgtcggcattctcggcaatctgactgggctgaagactctctcgctccggctcaacgcgcttgctggccaaatccctccagatctcgcttcttgcaccggcttgcgcaacctgtacttgcaaggtaatcggttctcaggcccgatccctgagtctctgctgggtctacgcgagctcgtgaggctcagccttgcctccaacactctctctggggaaatttctcggagtttcagcaacttgactaggctcaggactctgtccctcgagaacaattcgctctct

SEQ ID NO: 451 - DNA, 1086 bp, Eucalyptus grandis
cgcggccgcgtcgaccactcctaaaacatgaacacccttcccaggtcttctctccctcccctgttctctgccatccctatcactcttctcctcctcttcctccctcattctctctcctcaccacccaatgacaccaatgctctcactctcttccgcctcgaggccgacacccacggccacctcctctccaactggacaggctctgatgcctgctccgccgcctggcggggcgtccgctgctcctcctccactcactcgagcagccgcgtcactgctctctccatcccttccctcaacctccgcggacccattgactctctctcttccctggaccagctccgtctgcttgatctccacgataaccggctaaacggtaccgtcacccccctcgccaactgcaccaacctcaagctcctctacctcgccggaaacgacttctccggcgagatcccgccggagatatcctctctccggcgcctcctccgtcttgacatttccgacaacaacatccggggtgtcattccgggggaggtccgtggcctgagccgcctcctgactctccggctgcagagcaacctgctttctggcgaggtgccggatctctcggtgtcactcaagaacctgaaggagctcaacctgacaaacaacgaactgtacgggcatttgccggatggactactgagaaagtttggtgttcggagctttgtcggaaacgaaggactatgtggatcgagcccattagcagcttgctcgttatctgggacttcaccaccagcttcttcctctctcacagtgccgtctaaccctagctccatgccagagacaccggcaattggaccgggtcagaagcatcggcaaaaaggactgagcacaggggctatagtggcaattgcccttgcgaattgcgtggcattacttgttgtgacatcttttgtggttgcttactgctgctcaagagagcggaattcgagcttaaaagcaaatggagagagtactgggaagaggagaagtgggagtagccatggaagtgagaagaggagtgtatgcaagcggaggtgcggatagtgatgggacaaacgctacggg

SEQ ID NO: 452 - DNA, 564 bp, Eucalyptus grandis
aataatttcacataaaaataagagaaatcgaaacccagctcgtcggtgatgatcctcgacccccgtcgcatttcagatctgccaatccccactgcggactgaaataatttcacatccccacttccgccaacacgaagaagaagaagaagaagaagaagaagatcgatctccctctcggcgtcgatccctcgcctccgcagatctgagcgcgcccccgtctcatggcgcgcttcccgctcgcgatcctcgcgatcctcgtctcgccgttgctgttctccgccgtagccttctccaaaaccctcaagcgcgacgtgaaggcattgaacgagattaaggcgtcgctcgggtggagggtagtgtactcgtgggtcggggatgatccgtgcggcgacggcgatcttccaccttggtctggcgtgacgtgctcctcccagggagactatagggtcgtgaccgaattggaggtctatgcagtctcgatagtagggccttttccaacagctgttactaatttgctggatctgactagcctggatctccataacaacaaattgactggaccta

SEQ ID NO: 453 - DNA, 1153 bp, Eucalyptus grandis
ggcactgtgctttttcccactcaaatcttcaggatcccactcttgcctctttttatctctcccccatttttgcctaggaagaaggggagaaaaggagcaaaaattcactgaagaagaaggcctgtaaaagtcacccgttttctcaagcattccgttgaaagagagaacccaagaactgcagcttgaggagttcttgattgttctctctccctccctctctccctccttgagctgaagtctcaaaccgactttcttcccattatgttctacaggcaggcggggactcacgcttgcaaccccctcgtgatgatgacctgttgttaatgattgttgctgtaatgtcgctgagcaagaaaggagcgcttgagttcaattcgaatatctgaatcactctctcttgagtacttcatgaagcttcttcaagcagtcattcccacgacctcattgcttttcggtgtacttcttctcatccccttagttgttgctgatctgaattccgatgtacaagcactccttggtttcgcttcggccgtcccacatgcccggaaactgaattggagcccttctattccgatttgcagttcttgggtaggcataacttgcaatgtagacaaaacccgggtgacaaaggtccgtcttcccgctgttggtctttatggctcactgccgtcaaacactttggcaaagctcgatgctcttgaggtcttgagcctacgttctaattatttaaccggcaatcttccttctgatgtggcttccattccttccctccaatacttattcctccagcataataacttttctggctctctcccgatctctttgtcatctcagctcaatgtattggatttgtccttcaactcttttagtggtggcataccgccatccattcagaagctcaataggcttgctatattttaccttcaaaataattccatttctggtacaattcctgaccttaaccttcccaaacttaaacttttgaatctgagctataacaacttgtcgggttccatcccgaattctctccaaaaatttcctaactcttcattcgttgggaactctcttttgtgcggacaacctcttagccaatgctccactcttgctacctctccttctcctgcgcctgacactcagaacagcaacaacaggt

SEQ ID NO: 454 - DNA, 877 bp, Eucalyptus grandis
cccaactgtagaaccaccccaacatgagattaccaagcttgtcgcaccagcaccatttcccatggctcacttcctcgggaaactccgctccctgctcagcttgatcgtgtccttgtccttttcttcttcttcgcgcttccattcgcttctccggtcgcctcgctctcgaccgtgtcgatcaccgaaaccgcgaaccggacgttggtctgtgctcttataaagacccccggccagagcgtgtttctcaactgtaccagcttcccggcaggaattcaaattcctgctaatatcgatgcttccttcacgggcatcgtcggcggggacgggttcctctgcggcttgagaggtaagtatttttcgaccccgtcatccctggtttgctggagatactccgccaatggcaccgagtacagctacaggcgcatctacaggggtcctccggtgacagagctcgattccggagatgctcacgtgtgtggtcttgccaatgggactagccggctcaagtgctggcagtggcgcaggtttaatcggaccccggccccgagcaactggtccagcgtcgcggtcggcggggattatgcgtgcggcctgatgggcacggggaaagtcgcgtgcgtcggggacaatgtccccgtcgtgaataacaagcgaaacgggaccttcatagccgtcgcggccgggtctgggcacgcctgcgccatctcggtggataacaagctggagtgctggggggcagccgagaacgatccgccggaaggggtattcgtctcggtggccctgggagagaacaggagctgcgcattgaaggacaacggcagggtcgtgtgctgggggcagggcaatttcagcttgccggaacacctgggagacacat

SEQ ID NO: 455 - DNA, 3257 bp, Eucalyptus grandis
gagaactgaactgacccagagacccactttttctctcatcatcatcccttcaggatcatgagattttcgtctctcaaaagaagaaggtggatcatgaggacagcaatcatcattaccagtctgatgtgttgttcttccgctagagacagcatgacgctcagcagcccgctcagcgatgagcacggagacactctggtttctgatggagggaccttccaacttggcttcttcagccccaacggaagctcgggctctgaccacagaaggtaccttggaatatggtactacgactccgacccgcagaccgtagtttgggtagctaacagagaccaccctgtgttggatgtgactggagttttgacgctgacccaagatggtaacctcaaggtgttggacaaagctgggaaatcttactggtcaacaaatctcgaggaatcatcccatcttgcattgaaagttcagctactggacacaggtaatttagtcgtagccagagcaggagagagtggagaggcggagtctggctcggggaagatgattctgtggcagagcttcgattacccgaccgacacgttcctcccggggatgaagatggatgagaatatgaccctcacttcgtggagaagcgacgacaacccgtcgcccgggaactactcctttcagctggatcaagaagggcagtaccagtttgtggtctggagaagatctatccggtattggaaaagcggagtctcggggaagttcatcacctcggacgacatgccgtattccatctcgtacttcttgtccaacttcacgaccagcatagacaacaacgcttccgtcccgtacctcacatcgtcgatgtacatcgacacgaggctgatcatgagttcttggggccaagttcagtacctgaagcgcgactcagaaaaggtctgggctttcgtatgggctgagccgagggacagatgcagcgtgtataacatgtgtggggatttcggaagctgcaacagcgacgccgacgtggtgtgtaagtgcttgccgggtttcagtccgagctcaccggatttgtggaatttcggggacttttctggcgggtgcattaggaagtcaatattgtgcaacaaggggagcgagacgttcctcggtttgaaggcgatgaaagtaggaaagccggactcagaatttgtggctgcagacgaaatggagtgcaagaaagagtgcctcaatagttgccagtgccaggcttactcatttgaagaaggcgaatctgctgcagggcaaggcggttcgggtggtggggtctgctggatttggtcagagaatcttaataatcttcaggacggttatgatgaaggccgcgatttgttcgtccgtattgcagtttctgatatagaatctacagctagaaattgtgagatttgtggaacaaacttgattccatatcccctcagcactggatcccaatgtggagaccccatgtatagaagtttctactgcaacacatctacaggaacagtcaatttcaagtcgcctagtggcacctatcaagtgacacaaatcatccccgaatcacgtaagttccttatcaaatcgaaacaaacagatagttgcaaggtcctggagttcaatcggtctttgccttttcacttgtcaagctcgtgccgtggcaaaacaagcagtaaacctgaaatagagattagttgggagccaccaccagagccgacctgcattacatccacagactgcacagattggcccgattcaacttgtagcaccacattagatggtcggaggtgtctgtgcaaacccaattttcggtggaatcctctactccttaattgtactaaaggtaagaagcatgaagttctatcgagcaaaaaggtgccaccgtctgtagtcatttccataacatttgcatgtattcttgttctgattgctctcttaagcactgttgcttttatctacatacagaggaggaactccggcaagaaaaaagggaactggtcgaacatacggagatattctgcacgtcaactatatgacagtgagagacaagtcaaagaattgattgactcgggtcggttcaaagaggatagttcaaatgggattgatgttccattttacaatctggagagcatactagcagccaccgacaatttctcaaatataaacaagctaggacagggaggatttgggcttgtttacaagggcaaatttccaggaggacaagtactggcagtgaaacggctctcaagtttttctggtcagggttttgaggagttcaaaaatgaggttatcttgatcgctaaacttcaacaccgcaatctcgtgaggcttttgggttactgtgtagaaggagatgaaaagattttgctgtatgagtacatgcccaataaaagcttagactcctttatatttgatcggactttatgcatgtcattggattggaacacacgttttaagatcatacttggaattgctcgagggcttttgtatctacaccaagactctaggttgagaatcgtccacagagacctgaaaacaagcaacatcctgctggacgaggagatgaatcccaaaatatccgactttggattggcgaggatatttggagtcaaagaaatatcagtgaacacaaacagagtagtcggaacttatggctacatgtccccagagtatgcactggacggtttcttctcagataagtccgacgttttcagcttcggcgtcgtggtactcgaagtcctcagcgggaaaagaaacacaggattctatcaggctgagcaaggtttgagtctcttaggctatgcgtggtcgttgtggaaagaagagaaatcggtagacttgatggacccgacactccataaaagctgcaacatgaacgagtatctgaggtgcatcagtgtcgggctactatgcgtacaagaagacccgaacgatcgccccaccatgtcgaatgcagtcttcatgctaggcaatgaaactgccactcttccgacccctaagcaacctgcttttgtcatgagacgatgtccctcgagcggggcttccacatccagcaaactggagagctgctctttcaatgagctgactgttactctggtgaacggccggtagcagataaagtgcggccctactttttgattcagcattgattccatgtgcattaggaatgaatctcttcaatgcaattgtcagttggtttgaaaatgtgttgaggcaattttgatctctaagttcatcaaaaaaaaaaaaaaaaaaaaaaaaaaaaa

SEQ ID NO: 456 - DNA, 3257 bp, Eucalyptus grandis
gagaactgaactgacccagagacccactttttctctcatcatcatcccttcaggatcatgagattttcgtctctcaaaagaagaaggtggatcatgaggacagcaatcatcattaccagtctgatgtgttgttcttccgctagagacagcatgacgctcagcagcccgctcagcgatgagcacggagacactctggtttctgatggagggaccttccaacttggcttcttcagccccaacggaagctcgggctctgaccacagaaggtaccttggaatatggtactacgactccgacccgcagaccgtagtttgggtagctaacagagaccaccctgtgttggatgtgactggagttttgacgctgacccaagatggtaacctcaaggtgttggacaaagctgggaaatcttactggtcaacaaatctcgaggaatcatcccatcttgcattgaaagttcagctactggacacaggtaatttagtcgtagccagagcaggagagagtggagaggcggagtctggctcggggaagatgattctgtggcagagcttcgattacccgaccgacacgttcctcccggggatgaagatggatgagaatatgaccctcacttcgtggagaagcgacgacaacccgtcgcccgggaactactcctttcagctggatcaagaagggcagtaccagtttgtggtctggagaagatctatccggtattggaaaagcggagtctcggggaagttcatcacctcggacgacatgccgtattccatctcgtacttcttgtccaacttcacgaccagcatagacaacaacgcttccgtcccgtacctcacatcgtcgatgtacatcgacacgaggctgatcatgagttcttggggccaagttcagtacctgaagcgcgactcagaaaaggtctgggctttcgtatgggctgagccgagggacagatgcagcgtgtataacatgtgtggggatttcggaagctgcaacagcgacgccgacgtggtgtgtaagtgcttgccgggtttcagtccgagctcaccggatttgtgaaatttcggggacttttctggcgggtgcattaggaagtcaatattgtgcaacaaggggagcgagacgttcctcggtttgaaggcgatgaaagtaggaaagccggactcagaatttgtggctgcagacgaaatggagtgcaagaaagagtgcctcaatagttgccagtgccaggcttactcatttgaagaaggcgaatctgctgcagggcaaggcggttcgggtggtggggtctgctggatttggtcagagaatcttaataatcttcaggacggttatgatgaaggccgcgatttgttcgtccgtattgcagtttctgatatagaatctacagctagaaattgtgagatttgtggaacaaacttgattccatatcccctcagcactggatcccaatgtggagaccccatgtatagaagtttctactgcaacacatctacaggaacagtcaatttcaagtcgcctagtggcacctatcaagtgacacaaatcatccccgaatcacgtaagttccttatcaaatcgaaacaaacagatagttgcaaggtcctggagttcaatcggtctttgccttttcacttgtcaagctcgtgccgtggcaaaacaagcagtaaacctgaaatagagattagttgggagccaccaccagagccgacctgcattacatccacagactgcacagattggcccgattcaacttgtagcaccacattagatggtcggaggtgtctgtgcaaacccaattttcggtggaatcctctactccttaattgtactaaaggtaagaagcatgaagttctatcgagcaaaaaggtgccaccgtctgtagtcatttccataacatttgcatgtattcttgttctgattgctctcttaagcactgttgcttttatctacatacagaggaggaactccggcaagaaaaaagggaactggtcgaacatacggagatattctgcacgtcaactatatgacagtgagagacaagtcaaagaattgattgactcgggtcggttcaaagaggatagttcaaatgggattgatgttccattttacaatctggagagcatactagcagccaccgacaatttctcaaatataaacaagctaggacagggaggatttgggcttgtttacaagggcaaatttccaggaggacaagtactggcagtgaaacggctctcaagtttttctggtcagggttttgaggagttcaaaaatgaggttatcttgatcgctaaacttcaacaccgcaatctcgtgaggcttttgggttactgtgtagaaggagatgaaaagattttgctgtatgagtacatgcccaataaaagcttagactcctttatatttgatcggactttatgcatgtcattggattggaacacacgttttaagatcatacttggaattgctcgagggcttttgtatctacaccaagactctaggttgagaatcgtccacagagacctgaaaacaagcaacatcctgctggacgaggagatgaatcccaaaatatccgactttggattggcgaggatatttggagtcaaagaaatatcagtgaacacaaacagagtagtcggaacttatggctacatgtccccagagtatgcactggacggtttcttctcagataagtccgacgttttcagcttcggcgtcgtggtactcgaagtcctcagcgggaaaagaaacacaggattctatcaggctgagcaaggtttgagtctcttaggctatgcgtggtcgttgtggaaagaagagaaatcggtagacttgatggacccgacactccataaaagctgcaacatgaacgagtatctgaggtgcatcagtgtcgggctactatgcgtacaagaagacccgaacgatcgccccaccatgtcgaatgcagtcttcatgctaggcaatgaaactgccactcttccgacccctaagcaacctgcttttgtcatgagacgatgtccctcgagcggggcttccacatccagcaaactggagagctgctctttcaatgagctgactgttactctggtgaacggccggtagcagataaagtgcggccctactttttgattcagcattgattccatgtgcattaggaatgaatctcttcaatgcaattgtcagttggtttgaaaatgtgttgaggcaattttgatctctaagttcatcaaaaaaaaaaaaaaaaaaaaaaaaaaaaa

SEQ ID NO: 457 - DNA, 2307 bp, Eucalyptus grandis
ccggtctgaaaaccgacacttttgagtgagaaccggatccttttgcggtgttttggagggacgggaagtgtaatggggctcgcacgtttgctcctggttggcttcgtcctgctcgtgcttggctcgagagcgctcgtgtgcgggaatgcggagctggaggcgctcatggagatcaaggcctccttggacccggagaacaaggtcctcacttcgtggaccagcaatggcgacccctgcggcggctcgtttgacggggtggcgtgcaacgagcatcagaaagtggcgaccatctcgctgcaagggaagcgcctgtcggggaaggtccctcccgcagtggctcagctgaagtgcttatcgggcttgtacctgcactacaattccttgaccggagagattccaagagaaatctctagtctgaccgagctgacagatctctacctcgacgtgaataatttaactgggagtataccttctgaaattggaagcatggctagccttgaagtgctacagctatgttgtaatcagctcaatggtactattcccctgcaaataaaatcattgaagaagctgagcgttcttgccttgcagcataacaatttttccggtgatataattggcttggccgatctgcagagcttaaagagtctcgacttggcctttaatcggtttagcggtacgttcccggtggaaatagctaagattccacacctgcagactctggatgtacgaaacaattctctttctggatttgtccctactgctctgaagaatttgggggagagatttaactatcagaataacccaggtctatgcggatccggatttcattctcttagaaattgcaacaatttcggtcagaatttgatcccaaagacagcagacgtgaagaaacattgcaaccaaagccattgctcagaaccatcgaaactcccacaagcagctcttgttgctgggattgtctctgtcaccgtcacattggttggcgcaggactaataacattctatcgatatcgtagagggaaacaaaagattggtagtacagctgatgcttctgatggtaggcttagtaccgaccagtcaaaagacttatacagcagaagtgcatctccccttgtctgcctcgagtattctagtggatgggatcctctggatgatggccgctgtggaaatggattatccctgcaggcgcctaggtacacgttggaagaagttgagtcagcgacccaatacttttcggaggttaatttgttgggaagaagcactttttcatcggtctacaaaggcatactaagggatgggactcttgtggctatcaggagcatcaacgtgacgagctgcaaatcagaggaagtcgactttgtgaatggactgaatttggtaacttcgctaagacatgaaaacctcattagattgagaggtgtttgttgctccaagggcaggggtgaatgctttcttgcgtatgatttcgctcccaagggtaccttatcgcaatatcttgatttagaagatggaagcatccaggttcttgattggtccacaagggtttctatcatcaaaggaattgctgagggcattggatacttgcacaacggtgaaggcagcaagcctgcagttgttcaccaaaacatttccgttgagaagattctcattgatcagcagctcaacccactcataatggattccgggcttccaaagcttctcgccgatgatgtcatatactcagctctcaagactagtgctgccatgggttatatggcaccagagtacattacaacaggtcgttttaccgagaaaagtgatgttttcgcatttggagtaatcatcttccagatcctctcgggtaagcgactactttccagctcaatgcggtcagcagcagagtgttgcagtttcgagaactttatcgatagcaatctgaaaggaaatttcactgaacctgaggcggctattcttgggaagatcgcattacgttgcaccagtgaattgcccgataatagacccactattttcagagtgattgaggaactaaacgattggtccgtcaaacgtcaatgattgtacatagcgaattgtccgaagttgcatccatggaagcaccaatttaactcaatgagctatcaagctcagcggtgacagtgcaacgatgtatgatgatccctgaagaattaacagagtaatcttgtcctattgtataacagattagctttagctcatttgtactttgtctgttcacttgaatcattatcattttcgttttccctttgccatataatgatatgatttacttgtaaaaaaaaaaaaaaaaaa

SEQ ID NO: 458 - DNA, 3600 bp, Eucalyptus grandis
ggagaacccaacattgctttctctgccactctcactctccttctttcaatgtgttccagaagagttgtttcttcaatggagaccaacccaattcatctaatctaccatgtatttttcatcgtcatagggcttgtctctgtttctgcagccgaacagagtgcttcctccaggaaaacggatgcggaagccctgatcctgttcaagaaaatgatccagaaggacccgagtggagtgctatctgggtggcagctcgatcaggatctctgcgcttggtatggagtcacatgttactcagggagggtcactcaactcgatcttcacggccaaagtcttgaagcgaccatgtctttcgaccctttgagttctttagacatgttaactgtactcaatctgtcatcaaactcgttcgccatcgattcaacttccttgcttcaactcccctatggtttgaaacatcttgacctttcttttgtaggcctccttggcccggtccctgagaatttcttttccaagtgccccaatctcgtcgatgtcaatctagctttcaataatctaaaaagctcgttgcctgagaatttctttatgaatgctgataagcttcaggttctcgacctgtcttataataatctaagcgggtcaatttcaggactgaagatcgagaattcttgttctctattgcaacttgatctttccaacaaccagctcaacgagtccattccaacctccttttcaaactgcaccagcctccacacattgagtttagcaaataacatgttcactggagagattccccactcatttgggcgacttgctagtttgcaaaaactcgacctctctcacaaccatcttacggggtggattcctgatgagctgggaactgcatgcaactcgctaatcgagctcacgctttcctttaacaacatctcggggccaattccattgtctttctcatcatgttcatggttgcagagcattgatttgtctaccaacaacatatcaggcccctttccagattctatccttcggaatcttggttccctggagagtttgctactgagcaacaacaccatctcagggctatttccagcttccctctcatattgcaaaaagctgagaatcatagatttcagttccaaccagttttcaggtatcataccacctgatttatgtcttggagctgccttgcttgaggagctaagagctccagacaatctcatcactggaaatatcccacctcaattatctcaatgctcacaactcaagaagattgatttcagcttgaactatctagttggctcaattccagcagagattgggatgcttgagaatctggagcagctaatcgcatggttcaatggcctggaaggcgaaatcccaccagaattaggaaaatgtaggaacttgaagaatctcatccttaacaataatcatcttaagggtgaaattccaacagagctgttcaactgcagcaatcttgaatggatatcgctcacaagcaatgaactgactggtgaagtcccacgtgaggtcatgcttttgtcaagattggctgtactgcagctggggaataacagtttgagcggccagattccatgggagctgggaaattgcagtagcttgatgtggttagacttgagcagcaacaaattaacaggagaaataccgccgcgactggggaggcagcttggagcaaaaggaccggctggtattccttctggaaacacccttgtgttcgtaagaaatgtgggcaatacttgcaaaggtgtgggaggtctgttggaattcgccgggattagacctgaaaggttgttgcaagtgccgtcattgagaacttgtaacttcgcaagaatgtactcaggtccaatccttagcaagttcacaacataccagacagtggaatacttggacctttctgacaaccagctccgagggaagatcccagaagagtttggggacatggtagctctgcaggttctcgagttatcatacaatcagctatctggagaaatcccttcatcgcttggcagactaaaggatttaggggtgttcgaagcatcacacaatcgactgcaaggccaaattccagattccttctcaaacttatctttcctggtccagatagatctctcctacaatgatttgacagggcaaatcccacagagagggcaactaagtacacttcctgctagccagtacgaacacaatccaggactttgtggggttccgttacccgaatgtcggaataacgaaccagaaacaaacccagacgtggccatgggcacgaaaggaagagcaaagccagggactgcatcatgggctaatagcatcgtcctcggaattctactttccattgcttccatctgtattttgactgtatgggggatagcaatgcgttcaagaagaaaagaggcagaggaaatgaagatgctgaaaagcttacaagcagcacatgcaaccacaacgtggaaaattgacaaggagaaagagccactgagcatcaatgtcgcaaccttccagaggcagctgaggaagctgaaattctcccagctaatcgaagccactaatggcttctcagcagaaagcctcatcggttgcggtgggttcggcgaagtgttcaaggctacattgaaagatggctcaaatgttgcgataaaaaaactcataagattgagttaccagggcgacagagaattcatggctgagatggagacattggggaaaatcaatcacaaaaatctagtgcctctgttgggttactgcaaggtgggagaggagaggctattagtatacgagtttatggaatacggtagccttgaagagatgctccatgggagagtcaaaactcaagatcggagaatacttacatgggaggaaaggaaaaagatagcgcgaggggcagcgaaaggactgtgtttcctccaccataactgcatcccccacatcatacaccgggacatgaaatcaagcaatgtattgctggaccatgatatggaagcaagagtttctgatttcggaatggcccggcttataagtgctctcgacacgcatctaagtgtaagcacgctagccggtacaccaggttatgtcccaccggagtactaccaaagcttccgatgcacagcaaaaggggatgtgtattccttgggcgtcgttctcttggaactattgaccggaaagcgccctaccgacaaggaggattttggggacaccaacttggtggggtgggtgaagatgaaggtgagagaagggaagcagatggaagtcatagacccggccatgctatcgacaaccaaagtgcaggaggaagcggaagcagaagcagaagcagaagtagtgaaggagatggtgagatacatggagataacgctgcagtgtgtggatgatttcccttccaggaggccaaccatgttgcaggtagtggccatgttgagagagcttgtgcctggctccacaaccgtaagcagcaacagcacctgaaacatcatgaactgttaatgtttctctttcttattgtttatggtaagaagatagcgcctgtatgttttattcatatgttaagaattaagataagatcttttatgtaaaaaaaaaaaaaaaaaa

SEQ ID NO: 459 - DNA, 2961 bp, Eucalyptus grandis
tgggtctctctctctctctttctctgtgtgtctcggtccttgtgctcgcgggctgtttcgctttaccctcctctacttcaccgccaatgacttgcggagagatcattctgggtctgtgcctgtgacgtcccttcttgggattttcgtgcttcattcttctggtacactcctcgtttgtaaaatcccggttggcgagctgggtggagtgtttctttgcgttttgtggtcttttaggctcttgggtcgtcgttgttttggccattgaggccgtttcttgtccgtttcctgggagagtgaggtgcgcagacgagaacggaaggaaaaaggtgggaactttgaagcgtggactgtacggagcgtcgtgggctctgcgaaattgaagatggttttccgacgattcgtggtgatgctcttcatttgcacggcgtcggtctgcgctggcctcactgatcctcgcgatgtggcggcaatcaatagcttgtatgtttcactgggctatccgcctctacgtgggtggttacttgttggaggcgatccctgtgttgacaattgggaaggtgtcgagtgtgttatctcaaacataacgggactaaatctgagcggagccaatttgggtggagaattgggcgacactttggacttcgcatcactcttgtcgattgatttcagcaacaatcagattggagggagtgttccatcccatgtgccgcctaccattcttacaatgttgttgggcaataaccatttcagtggaataattccagactcgtttgaagagctaacgagtttggcacatctggatttgtcaagtaataacctcactggtcctttacctccatcatttggaaacctgtcagctgttaccacattgcacttgcagaataataaactcattgggactctgaatgttctagaggatctccctctaattgatttggatatagagaataacttattctctgggcctattcctccaaagttgatgactattccaattttcaaaaaaggtggaaatccttttaatacaagtgtaattccatcaccagcaccagcaccagagccaacctctgcacctcctccattcataggccagccacctccgagcgtgccttctaaagatggaaatggatctagagcagaggcaccaaaatctgctcattcagagggagggtcgagggttaaaaaggtcattttgatagctgttataggggctctggtggtcgttgcaattacattactgtgcctatgcttgtggagatgcagcaaaaagaagcaaatgaatgagatgggcgagggacataacatgggtgtatacgcaaacagtcaaggggctgctaaaagcaaagattcatcacgacaacctaacatatatacggagagacaatttccacgaaaagctgttccagaacctttaggcaagatgggagaagaccatggaagagccggtttaagtaacagacaaatggatgtgaccaaagcattgagcttgaggcagaagaaggaccaagtgggagactccagtttgcccttgcagcctgtggtttctcctcttgcaccacccattctgaatgagaaggttatcagaaatcctgttgtttctgctcagccaactgtacggaaacggccttctgagagaacagtctcttcaccttcagtcccattttacagcatagcatctcttcaggagttcacaaacagcttttctcctgaaaactttattggagaaggcacactcggtagtgtctacaaggccgtgcttcctgatggaaggcttttagcagtcaagaagctaaaggctgcagtttccaggcaccagagcgatgagaaatttggtgatctggtgtcgagaatctataagattcggcatagcaatattgtggagctggtgggctactgcgctgagcatgctcagtggctacttatttatcagtattgccgaaatgggacactgtatgatgccttgcatttggatgatgaggtccatggaaaactttcatgggctacgcggattcgtgttgccattggagctgcaagagccttgcagtatctgcatgaggtttgtcagccacctgttgtgtacaggaactttaactctaccaacatccttctagatgataagctcgaagcacgagcctcagattgtggtctggcttctttaatatcatctggctctggaagtcagctttccgagcacctcaatcctaacggttacaccgccccagaatctgagtcaggtgcctattcctggcaaagtgatgtgtatagctttggagttgtaatgttggagcttctcactggtaggaagtcacttgacaggtcaaggcctagaggggagcaatttctggttcgatgggcaataccccagcttcatgatatcgatgcactgtcaaagatgatggatccttcgcttagcagtttctatcccaccaaatcattgtcgcgctttgctgatataatctctcgatgcgtgcagagagagccagaattcaggccgccgatgtctgaagttgtgcaggacctattgcgaatgatgtgaagcgaagttcaaaaatcaccccgagactgaagtgtattaggtaacttaataatgtctatagcaatggtcatggaggagacaacagaacccagaatactttgatatttaattacggtgcagtatcagctacggtaacctctcgtccgttcgactgatggatcagatgttcacatcggggtcgaaacttatatcgatgtagcggacgggtattttagaaacttagagatagatgtcttgtgcagttgatgacaagttgtgattgtttggttttgtgattcttttcctgtgcaccagatggacaaacatcttctttcggcttgttggacataggattgtcccatgattcagtttactcagttctttgttcatttcaacagtttctgtgactggtgagagactacatctcttgctgttgatcaaaaaaa

SEQ ID NO: 460 - DNA, 2270 bp, Eucalyptus grandis
gtaacttcttcttcttctccatttgaattgtttggcgctgtttacagatgaagattggagtgacgagacacatctttttgctgaggaaggagtgtgaaggtgcttcaatcttccccagaagccggggaggctagaagagctgctcgttcttcttcgagcctaactattctccaagtatattgctgtgaactggctgtagaaaatggaagggaagcacctcgtttttctgacaattctcttgttggaatcgatttgctcgaatgtctcggcgatacccaacgaggataagcaagcattactggattttcttggcaatgtttccctctcgcgccctctcaattggaacaaggattcttctgtgtgccggtcctggacaggggtcaagtgtaataacgaccaatcgagggttgtcgccctccagttgcccggagtggggatcaaaggtcgaataccgccgaacacactgagtcgcttatcggcacttcaaatgctgagcctcagattgaatagtatatcgggttcattgccgtctgatttctccaagctcaagaacctgactggccttcatctccagagcaacaacttctcgggtccattgccttcggattggtccgtttggccgaacctcaccttcgttaacttgtccaacaacaaattcagtgggagcatacccccttcaatttccagtttgacctacctagctgctttggatctggcgaacaactcgctttccggcgaaattcctgatctaaatctccccaaattgcagatgctggatttgtccaacaatgatcttgcaggacgcgtgcctcgttcgcttcaaaggttccctagtcagacatttgtagggaacagtgtttccttcgaggttgaggcattacctccgacacttccagctaaacctcctagcgccggaccacccaaaaaggccagcaaactcagcaaaacggcacgtttaggaatcatcaccggtggttgtgtactaggagccatggcaatcgctctgttcatgatcatgttctgttcgagcggaggaatcaaaaggagggtactgctgaagtcgcagaagcaagcagcgtctcaaaacaagagagaggtcgccgagagccaagagaaagacaacaagatcgtgttcttcgagggctgtaactacgcattcgacctggaggacttgttgagagcttctgccgaggtgctggggaaggggttgttcggggcgagctacaaggcggccctggaggacgcgaccacgatggtggtgaagaggctgaaggaggtgggcgcgggcaggaaggagttcgagcagcagatggaaatggtggggcgcatcaggcacgagaacgtcgcccagctcagggcctacttctgctccaaggacgagaagctgctcgtgtacgatttcttccgcgaagggagcgtgtcggctctgctacacggcaccggacgcgaacgccggggtcctctggactgggaaactcgcctgaagatcgccatcggcacggcgagaggcatcgctcacgtccacgcgcaaaacggcgggaagctcgcccacgggaacataaagtcctccaacatattcctgaactccgagggattcggctgcgtgtcggacgtcgcgctggcgccgctgatgaaccaaatcccgctgccgctgatgcggatctccggctaccgcgccccggagataacggacagccggaagccgacgcaggcgtcggacgtctacggcttcggggtcctgctgctggagctcctgacggggaagtccccgatgcacgccacgagcggcgacgagatggtgcacctggtgcggtgggtgagctccgtggtgagggaggagtggacggcggaggtgttcgacatggtgctcctgcggttccccaacatcgaggaggagatggtggagatgctgcagatcgggatggcctgcgtcgcgaggatgccggagcagcggcccaggatgccggacatgcttaggaaggtggaggagatccgccgcgcgcacgtcccgacggcgcagccgtccccggatatcaagtccccggcgtcgacttccaccccgtccccgacccgcccgggggccgagacggcgccggcgccttagaactccgtccacgaagcgtcgttgtataagttttggtcaattcacctcgaattgaacgcaaaatcagacgagacgtgtagtagcgctgctactgttttttctctctgtctcgagcacgagtttaattaattgctcgaattcgaagaatcaaaaaaaaaaaaaaaaa

SEQ ID NO: 461 - DNA, 2175 bp, Eucalyptus grandis
cccaggagacatcacccattttcctaagtattaccagatcaagagaataacctgaagctgtgttctttgctactccgcatccgttattttcttcggactctgctccgatgggagtgaagagagcgaattcctctctgtgctgcgtggttttgctcggcttgtgggcttgcgtacatgggttgctctctcctagtggtgtcaatattgaagttctagctttgatggacataaggaatttgctagtggatcctcatcaagttctgaacaattgggacgcaaacgaggttactccttgtacctggactgcgatcacgtgtgaggctgatgtcgtcactaatctagaaattccaagacagaacttatctggaacgctttcgcatagcattgggaacttgattaatcttaaatatttgttccttcaggacaacaacatttcaggatttattcctcccgagcttgggaagctccagaaacttgaaatgctcgacatttccagtaactcattctctggtgaaattcctaccgagctatcccatctcaagaacctccaacaactgagaatgaactacaataacctttcgggtgcaattccagcatccttcactaacatgacccagcttgctcttctggatctatctaacaacagtttgagtggtccagtgcctcaactgcatgcgaaaacattcagtcttcaggggaatccaatgtgcgtcggcagaccaaaaggagattgtttccggattccaccggcaccaattatatttagtgggaacaattcactaaattctcagccttctgggagatccaaaagccacaaagtagccttggctgtgggttcaacccttagttgcatctccctactcatcttcggattgggcttccttttctggtggaggcgaagacacaaccagcagatcttcttcgatgtaaatgagcaacatcacgaagaaatcaacctgggaaacttaaagaagttccacttcagggaacttgccaacgcgaccaacaatttcagcggcaagaacttgattggaaggggtggttcagggcacgtgtacagagggtgcctcagtgatgggatggtggttgcgatcaagagactgagaaatgtcgatgcccttggaggcgatgtccagttccagacagaactcaggatgatcagcctagcggtgcaccgcaaccttcttcggctctatggattttgtatgacccaaacggagaggcttctcgtatacccctacatgtccaacggcagtgtggccactcgtctcagagccaaaccaaccttggagtggagcacaaggaaaagaattgcgttgggggcagcaaggggactgttgtacctgcacgagcaatgtgaccccaaaattatacatagggatgttaaggcggcgaacatattgctagacgactactgcgaagctgtggtgggagactttggattggcaaagctcttggatcatcgggaatcccacgtgaccaccgccgtgaggggcacagcagggcacattgctccagagtacctgttaagcgggcagtcctctgagaaaaccgatgtttttgggtttggaatccttctgctcgaactgattactggcctgagagctcttgagtttggtaaagcagcgaaccagagaggggccatgcttgattgggttaggaaagttcatctggaaaagaagatagagatgctagtagacaaggacctaaaggacaattacgaccggatcgagcttgaagaaataatccaagtgagtcttttgtgcacccaataccttccaacaaaccggcccaagatgtccgaagtcgtcaggatgctggaaggtgatggtctcgtggagaagtgggaagcttctcagagagctgaatcaacgaggtgcagagcagcgaacgagttttcctcctccgagcgttactccgatctcaccgatgactcctctttgctcatacaagcgatggagctttcaggaccaaggtgaagaagtcactcaaaatagcgaagagctatggaagaattaaaggaatatgaataacgcgatcatagctaaggcatgaatagcaacattaaaatcaatactaagagtgtactaatgtttcactgtacagattctgatctgatctaaactgctcttagcgaagggaataaactcttcagcacgcaaaaaaaaaaaaaaa

SEQ ID NO: 462 - DNA, 2138 bp, Eucalyptus grandis
ctctctctccaccaccactcctcctcccctcaccttaatctctcctccgatcccacaccaaaacccccgccccacctccatggcggccccctcctcctccgccgcctccgccgccgtgttcgccctccactcgctgctgctgctgctgctgctcgccgccgccgtcgaggacgacgtgctctgcctcgagggcgtcaagcgctccctcggcgacccccagggttccctcgccgactggaccttcgccaacacctccgcctcccacatctgcaacctcaacggcgtcgcctgctggaacctcaacgagaaccgcatcatcagcctcagcctcaccggcttcggggtctccggcggcctccccgagtccctcaagaactgccacagcctccagacgctggatctctcccagaacaagctcgacggccccatccccgcccaaatctgcgagtggctgccttacctcgtcaagctcgatctctcctccaactcgctcgccggccccatccccagccagatcggcgactgtaagttcctcaacaacttgattttgagcgacaacaagttgaccggcgccattccttacgaggtcggtcgcctggaccggttgaaggtgttctccgtccggggcaatgatctctccggatctataccgtcggagctgtccaaattcagttccgacgatttctccgacaacgacgatctgtgtggtaggcctcttgggtcgtgtggggggttgagtaagaaaagcctcgctataattatcgccgcgggtgttcttggagccgcagcatctttgttgctagggtttgcgctctggtggtggtactttagtggagccagtaggaagaagagaggatacggcgctgctgctgataaggacgatagtagttggattgagtggttgagagcacacaagcttattcaggtgtctttgtttcagaagccccttgtgaaggtcaaattagctgatcttcttgctgccactaacagtttcgattctcggaacatcgtgatttccacgagaaccggggttttttataaggccgtgttgtctgatggttcggctctcgctgtgaagaggctcagtgcctgttcgattggcgagaagcagttcaaattggagatgaacagattggggcagcttaggcatcccaatttggtgcctcttttgggttattgtgttgtcgaggatgaaaagcttttggtgtataagcacatgcctggtgggactttgttctcccatttgcacatgaacggtcaaggcaccactggtcagtacagctcattggattggccttccaggcttagaataggcgtgggtgccgcgagagggctcgcttggcttcaccatgggtgccagcccccatatttgctccaaagcattagctctcatgcgattctccttgatgatgatttggatgcacgaatcactgactttgggttggcaagactagtcaatcctcgtgattcgaatgacagctcatatcgcaatggagatttgggtgagtttggttatgtggctcctgagtactcgagcactatggttgcatctttaaagggcgatgtatatggttttggagtggtactcttggaattggctactgggcagaagccattggaaatctgcaacgtggagcaagtattcaagggaaatctagtggattgggtcaataatttgactagcagtggtcgaagcaaggatgcaatcgatcgatctatctgtgggagaggacacgatgatgaaattgtgcagtttctgaaagttgcttgttcttgtgtggtttctaggccaaaggataggccttccatgtataatgtatatgagtcgctgaggaccattggtgagagacatggtttttcagaagcagatgatgaattccctttgatcttcaaacaagattccgacaataaagagtagcctgaaatctctgcatttgggaatcttttcatcttatgctatgttctgaatgatgtcttttgctggtttctactccatggggctatccaattcttctggcaatttttggataaattctgtatcatacatgaaccatcatctgatgtagcattctacatagtttggggaagtaatgtttgtcaatctgaaaaggtacttcctgttcaaaaaaaaaaaaaaa

SEQ ID NO: 463 - DNA, 3295 bp, Eucalyptus grandis
gtctaaagaagcttgagggatagacaagccaaagtaagagagatagagagaaccagttgatccaataaaggtcagatttttatgctttgctcacacacacccatctgaagctactttgtgtcatgtcattcccctatccttctcctcaaacccagcaacatacaattgctttgtctaaacactagtggtctatgtctgaaagcaacattttctttgagaatcaatgagggtcctattcattgttctgggggttgtacttctgtgcactgtaattcctggttcatcttcttctgtcagtgatgttgatgtcctacttgcgctgaagcaaggattccagtcccctgaaccggctttaatcacttggagttcttcaaactcgagctcagtttgcttatggtatgggattagatgctcaaggggacgcgtggtttcgctcgagctgacggatttgaatctgggcggctctgtctctcctcttgtttcaaggctccatagccttgtcgagctctcactcgctgggaacaatttcagcggcacaatcgtgatcgccaacttgagtagtttgaagttcctgaacatctccaacaacctgtttagtgggagcttggactggaactactctagtatcgcaaatttgaaagtgttcgatgcatatgataacaacttcacgggtttgttgccaacgggtgtaattgacttgaagaagatcagatacttgagccttggaggcaactactttcagggggaaatcccaaaaagttacggggaattagcggctctggagtacttgtcggttgcggggaatgggctgaatggaaaattaccgagcgagttgggaaatttgacagagctcagagagatttacttgggctactacaatgtctttgaaggaggcattcctagagaatttggcagtctgataaatcttgttcacatggatctttcctcgtgtggattggaaggcgtgataccgcctgagttggggaatttaaagaagctacacacattgtatctacaattcaattttctctctggtccaatcccaaagcaagtcggcaacttgacaagcttggtgaatcttgatctctctgtcaatttgctcactggagagataccatttgaagtcgcgagtctccagaagctgaaacttgtcaacctcttcttaaacaagctacacgggtcgattcctcagttccttgcagacctcccaagcctggaaactctagccctatggacgaacaacttcacaggtgtgattcctgaggatctcggcaggaatggaaagcttcagtatctagatttgtccaccaacaagctcactggaatgatccctcgggatttgtgctcacccaaccagctcaagatcttgatcctgttcaacaatttcctctttgggccgatcccggaagctctaggttcatgccatagcctggtaaaggtgaggttggggcagaactacttaaatggaagcattccgaacggcttcatttacttgcctcagctcaaactaatggaattgcagaacaactacctgtcaggagctttgccagagaatgtcaaccggtcgtcgaagcctgcgatgttaaatgagctcaacctatcaaacaatctcctttcgggtcctcttccgtcgtcgctctcaaacttttctaacctccaaatcctgcgcatcagtgggaatcaattttcaggtccgctcccggcatttacaggggacttgaggcaggtggctaagctcgatttgaggcagaatttcttttcaggtgagattccaccggatattgggaactgttaccatctcacctacctagacatcagccagaacaacctctccggtccgatcccgctcacaatttccaagattcctatcctcagttacttgaacatctctaggaaccacttaaaccagagcatacccgaaaagatcagtacaatgcagagcctcacgattgcagacttctctttcaactatttctcgggtaaaatacccgaatctgggcaatttgccttgttcaactcctcttccttcgtgggcaatccagggctctgtggttctgtcctagacatcaagtgcaatctcaccacattcacgagcacatcctccagaattcatttcactttcaagttaatgttcgcagtcggcctactattatgctccttagctttcaccacagtggccataatcaaagccaggtcatttaaaagaaaggccggtgccggctcgtggaagatgacgacatttcagaaactcgagttctcagtccaagacatcctggaatgcgtcaaagacggcaatgagatagggagaggtggagctgggatcgtctaccatgggaaaatgccagacggcacagagatcgcagtcaagaaactcctaggattcggcacgaatagccatgaccgtggcttccgagcggaaatccaaacgcttggcaacatccggcataggaacatcgttaggctcctggcattctgctcaaacaaagaaaccaatctcctagtctatgaatacatgaaaaacgggagcctaggtggggtgctgcacggcaagaaaggcgcattcctgggatggaacttgaggtacaagatcgcggtcgaagctgccaaaggcttgtgctacctgcaccacgattgctgccccctgatccttcaccgagacgtgaagtcgaacaacattctgctgaactcgagctatgaggcgcacgtcgctgacttcgggctggccaagttcttggtggacagcggagggtcggagtgcatgtcggtgatcgcggggtcctatggctacattgcccctgagtatgcatacaccttacgggtggatgagaagagcgacgtgtacagcttcggggtcgtgctcctagagctcctgaccgggcggcggcctgtgggcgacttcggggatggggtcgacatcgtccagtggacgaagatagccaccaccaactggcggagggaggaggcgacgcgtgtggtggacccacggctgagcctcgtgcccaaggacgaggccacgcacgtgttcttcgtcgccatgctgtgtgttcaggagaatagcaccgagcgtcccacgatgagggaggtggttcagatgctctcggagttcccccgccacccgccgccggagcactactcctcctcctcctcttcttctacttcttcttcctcagcctttgccaagaacttcaccggctaaaaagaaacatctgctcatctaatttagagtgtgaatgtgggatcttatatataacaaagtgtgtgagctctcgacaaaaaaaaaaaaaaaaaaaaaaaa

SEQ ID NO: 464 - DNA, 371 bp, Eucalyptus grandis
cttgcatctaatggtatttgagttggttaagaactctttgcgtgctgtccaagaacgattcatggattcagataaagttgcacctcctattcgaattattgttgctgatggagacgaagacgttacaatcaaggtctcagatgaggggggtggcatcccaagaagtggtcttcccaaaatcttcacgtatctgtatagcactgcgaaaaaccccctggatgagaactcagatcttggaatagctgataatgtgactatggccggttatgggtatgggcttccaatcagccgtctgtatgctcggtacttcggtggtgacctgcaaattatttctatggaaggatatgattcgcaagaaccgcttccgtgaa

SEQ ID NO: 465 - DNA, 381 bp, Eucalyptus grandis
tgattccaacatgactagtaacgaagcttctgaaaatgtcacggtaatggtcagtgttgaagataccggcatcggcattccattgcgggcccaggatcgtgtatttatgcccttcatgcaggcagatagctcaacttctagaacttatggtggaactgggattggcttgagtattagcaagtgtctggttgagctgatgggtggacacataaacttcataagccggcctcagattgggagcacattctcctttacggctgtgtttggaagatgcaaaaggcttgtgtttgctaatgtgaaaaggacttttgaagatcttccttctggttttaaaggattgaaagcaatagtggttgatggtaagccagtcagagctgccgt

SEQ ID NO: 466 - DNA, 393 bp, Eucalyptus grandis
gtttattctgcccaccctaagatctgccaattcaaaaccacaagctcattggtcaccatccgcaactccagtcttcgagcaggcagggaacaacaggcatggaggtgggtcagatgcagaggaggttggtagagttcaccaaatcattgttcatggaggaagggtttcttggacgggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctg

SEQ ID NO: 467 - DNA, 534 bp, Eucalyptus grandis
gccaattcaaaaccacaagctcattggtcaccatccgcaactccagtcttcgagcaggcagggaacaacaggcatggaggtgggtcagatgcagaggaggttggtagagttcaccaaatcattgttcatggagggtttcttggacggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcttggcggccggcggttccatcccagcgacggaaatcacgag

SEQ ID NO: 468 - DNA, 359 bp, Eucalyptus grandis
agaagatgttagttaagtgggcagagcatttcccacattataaagcaagtcaattttgtatttatttttttaagaccacatcaagccactgaaaatcactttcagaggttcttctttagcatttatagcttctctgatctgatctgatctagcggtttattctgcccacccctaagatctgccaattcaaaaccacaagctcattggtcaccatccgcaactccagtcttcgagcaggcagggaacaacaggcatggaggtgggtcagatgcagaggaggttggtagagttcaccaaatcattgttcatggaggattctgagaagctgctcaatgatctgacgtcggctctagagcagc

SEQ ID NO: 469 - DNA, 391 bp, Eucalyptus grandis
ccctaagatctgccaattcaaaaccacaagctcattggtcaccatccgcaactccagtcttcgagcaagcagggaacaacaggcatggaggtgggtcagatgcagaggaggttggtagagttcaccaaatcattgttcatggaggtaaaaagttcaaacttgtaaaatttatgtgcgtttgtagttccttatttgtttctgggttttgtccgattgtgttggtcttgacttcgggaaaattgttctgtttttggttgagaggaagggtttcttggacggtcagtttttgcagctccaacagcttcaggacgagagcaaccctgattttgttgtggaagttgtgtccctcttctttcaggattctgagaagctgctcaatgatctgacgtcg

SEQ ID NO: 470 - DNA, 418 bp, Eucalyptus grandis
ctttgtcacagtgcatcttgctcaagaggtcatggactcgttagatgttgagactgagtcatcgtcgaagaataccttgagtggcttccaagttgctgagagacgtctcagctgggcgaaattcaagacctttagccaacatgaatgtgtttgttcttacccttcctctacctacgacctcatcaatctaattgtatcagttgaggatacaggagttgggatcccatttgaggcccaatgtcgtgtttttactcccttcatgcaagttggtccttccatatcccgtacacatggagggactggcatagggctaagcataagcaagtgtttggttgagctcatgaacggagaggttggatttgtgagcatacccaatgtaggatccacgtttaccttcacgggcggcttcaacaatggg

SEQ ID NO: 471 - DNA, 331 bp, Eucalyptus grandis
gtttagagaggtccttaatttgattaaaccggtggcatctgtgaagaaactgctcatcacattgaatttagccccagatttgcctgagtatgctgttggggatgaaaaacgcctcatgcaagtcattttaaatgttgttggtaatgcagttaaattttctaaagaaggtggcatttcgataaccgcctttgtggctaaagcagagtatctaagagaagccagacctcccgaatttattccagtgccaagtgataatcacttctatttacgtgtacaggtgagagattctggatcaggtattaaccctcaagatattcccaagttattcaca

SEQ ID NO: 472 - DNA, 558 bp, Pinus radiata
catggatacagacttggatgctacacagaaggactatgctcaaacagcacaagcaagtggaaaagctttaataacattaataaatgaagttctggaccaggcaaaaattgaatctggacgtcttgaacttgagacagtccctttccatattcgcactgttctcgacagtgttttatctctcttttctgccaaaacacaggccaaaggcatagagctggcagtatttgtatctgaaagagtcccagagattgtcatcggtgatcctggacgatttcagcagattatcaccaatcttgtctccaattctgtcaaatttacggagaatgggcacatttttgtttgtgttcatcttgcacaggaaattgacgttctaacacataggctctctgcttacaaaaaaattggagaggatcctgcaataaataactacagtttgtccaataccctgagtggttcagaagctgcagataccagaaacaattgggaatccttcaagatattacatgaaattggcagtgatgaattattttctgaatctgatggaagagggcggattgc

SEQ ID NO: 473 - DNA, 446 bp, Pinus radiata
ggctcttctcaatccacggggacgcttccagagaaggagtcggcgaatgtatttccagataatttcacagacagggattatatcaacattctccaatccatggggcaagctgttcacatatttaaaccttcaggagaaataacttactggaatcattctgctgagtttctttttgggttttcagagtcagaagtgcttggccagaatgctatggagcttcttgtggaccagagcaattttaatattgcaagcagtatgattcatcggattatggcaggggaaagttggaaggggcaatttccgctgaaaaagaaatccggtgagctcttttcggcagtaatgtccaacacaccattttatgatgacgatggtacctttatcggtgttatttgtgtctcaactgatgtgtgcccttttcaaaaaccacctggtttgcaacttggtga

SEQ ID NO: 474 - DNA, 796 bp, Eucalyptus grandis
attggaagtaagatcattttctatgcatgacatgataagagaagcagcttgcttggctaagtgcttgtgtatctacaaggggttcagttttgaattggacattgataggtccttgccgaacaacgtaatgggcgatgaaaggagggtttttcaggtaattctgcatatgatcggtaacttgctgaatgacagtaatcaagggaaattagttacccttcgaattcttcgtgagaaagccagtggaagtcagggaaggtatgatcgaggttgggtgacgtggaggtccgaatcaactgatagaggtgtgcgtatcaaatttgaagttggaataagcgacgacatttctctgttggagaggtcagtttcgacaatccagcttggaggtcggaaatacaacagtgatggggttgaggaggacttcagcttcagcatctgcaaatggctagtacagttgatgcaaggtaacatctgggtagtcccgaacactcagggcttcgctcagagcatgacacttgtcctacggttcccactccgagagtccatctcagtgaccatttctgaaccggggccatctccagattatacactctccaactcagtcttcacaggcttaaaagtattgctcgtggactctgacgatgcgaacaaggccgtcacccggaagcttcttgagaagctaggctgcaaggtgtccactgcctcttcgggattcgagtgcctcggcgctctccgcccctctgaatcttctttccagattgtccttttggatcttcacatgcccagtcgacgcggccgc

SEQ ID NO: 475 - DNA, 271 bp, Eucalyptus grandis
ctgctcagaagctgccaatatcaggttaccaccacaaatcaggcaatcatggccttgaaaatgttaagggagaaccgggacaagtttgacctggttatcagtgatgtgaacatgcctgacatggatggtttcaagctactggaactcgtggggcttgaaatggatttgcccgtgatcatgttgtcagcttatggcgatcccaagcttgtgatgaaggggatcactcatggtgcttgtgactatctgttgaaaccgggtcgacgcggccgcg

SEQ ID NO: 476 - DNA, 429 bp, Eucalyptus grandis
gttattcacaaaatttgcacataaccaatcattagcaaccagaaattctggtgggagtggactaggtcttgcaatttgtaaaaggtttgtaactctcatggatggacacatatggattgaaagcgaaggcattggcaaaggatgtactgccacgtttattgtagggctgggaatcccagagaagttgaatgaatctaagttccctatattacccagagggtcatcaaatcatgtcctggccaatttttctgggctcaaagtgcttgttatggatgacaatggtgttggcagggcagcgaccaagggacttctcctacatctgggatgtgatgtgacaaccgtaagctcgggggatgagttgttgcgtgctgtctctcaggaacacaaggtagttcttatggatatttgcacgcctggtatagacagtta

SEQ ID NO: 477 - DNA, 2652 bp, Eucalyptus grandis
acgaggatgagagagccttcaaaacattggtcatactcatatctgcttcgctatgtaccttggtgattggatgcctctgcatttttttactgacaaatggagtatcaaaggaaatgaaactgagagcagaacttataagccaccttgatgcaaggaggcgagccgaggcatcaagcaactacaaaagtcaatttctggcaaatatgagtcacgaattgcggacgcctatggctgcagtaattggattgctggacattcttgtttgtgatgattgcctaacgaatgaacaatactcaacagtcacccaaattcgaaaatgctcaaccgctctgctcaggctgctgaacaatatattggatcttagcaaggtggagtctggaaaactagtgctggaggaggcggagttcaatttagcacgagaactggaaggacttgtcgatatgttctcggtgcagtgcattaatcacaacgtggagactatcttagatctttctgatgatatgccaaagttagttcgaggggactccgctagggttgtccagatatttgcgaatcttatcagcaattcactcaaatttactccatctggtcatattattatacgaggatggtgcggaaactcaaggaccatgagtgactttgtaaagcttcctcttgagcataaaatatccatttcttcacttaagacaaagttgaagcaacatggtagtcacgcaagaagggcatccaagaaagacaacaaagtgaccctctggttcgaagttgatgacactggctgtggaattgatccaagcaaatgggaatccgtttttgaaagctttgagcaggccgatccatcaacaactcgattacatggcgggactggtcttggcctatgcatcgtacgaaccttggtcaacaaaatgggtggagaaatcaaagtcatcaagaagaatggcccgggaactctcatgagactttacttactcctcaatgcacctgttgatggcacggaacataactgctcagtggattatgccgtgcacaacataagagtgctactcgcacaacatggaagcacgggtagatttataatgtctggatggctgcgcagaaatggagtttccactctggaagcatctggatggaatgaattgacccagattcttcaggaactctaccaaggcagaaattcaggtgctccatacaggactgtcaatacggaacatgcacatgaactcccgagatcagaagtgacaactttcgatgatattcaaagtgagatcctcatcatagtcgtggatatagagctacttgacctaaacacagatatatggaaggaacagctcaatttcctagacaagtaccacaggaaggcaaagttcgcatggatgctaaaccatgacaccttcaatgccattaaggtggagctccgaaggaaaggacacatgctgatggtcaacaagccgctatacaaggccaagatgattcaaattctggatgctgccataaaggagaggaactctgaactcctgaaaagggcctccaattcttcaaaaagcatgaataaagaagaggacttgcacgagtgtctagaaatcgactctgagcactatgagggagcgagctctgatgaactggacacagttgaaacatcacgttctggttgtaccaatacatctcctggtgaacaaaagcaacaggaagggatcaaaacccctcctgctctacaacacaggacatcgaactatcactcattcaattctactctgctgtcttccgactataacaatttagggaacaaagaagaagcgtgtccaactagtccccctttggaccacccagataatgccgaaggcagattcaagtgcacgaggagcgtgttttcttcaaaagaaaaggaagatggaaattcagaagcacaggaacaacttctgatcagcaagcgtcctccagccaaagttgattcgtgttccagtaaagaattggaccagaaagggtctctggagggcctgtgcatactacttgccgaagacacgccagtgcttcagagagttgctacgatcatgctggaaaagttgggggctaaagtcattgctgttggagatggcttgcaggcggtgaatgccctgaacagcagtctagatgtagatgcagaagacttcaggacgacgttgcatttgcaaaacgcgaacaggatgcctcaagcaggaacacgaagttggcaaccttacgacctgatccttatggactgtcaaatgccccagatggacgggtacgaagcaacgaaagcaatcagaagatccgaggccggaagcggcctgcacattccgattgttgcgctgaccgcgcatgccatgtcatcagatgaagccaagtgcttggaggtgggaatggacgcatacttgacgaagccaatcgactataagcttatggtgtccacaattctgtcgctcaccaagggagtcaactgagagaacctgctaagacaacttagagagaaccaaagaaagccagattctaaagtctacacagtttttgcttttgaaatgtgaaagaatcagtatgattaacgaactgggcaagtataccagtgaccccatctgcaatctgtaaagacatctgagtttctctagcttatttctgagcatattcggaaaaaaaaaaaaaaaa

SEQ ID NO: 478 - DNA, 388 bp, Eucalyptus grandis
gcggatgatgctttggagtatgtcagtacccttaattttggcgatccatttaggaagcatgaaatgcgatgcagattcaagcagaaacctccatggccttggcttgcgataacaacatcgtatggatttcttgtgattgcgatgctcactgggcatatattttatgcaacagtaaataggattgccaaagtcgaagatgactaccagaaaatgatggagctcaagaagcaggctgaggcagctgacatagcaaagtcacagttccttgccactgtttcccacgaaattagaactccaatgaatggtgttttaggaatgttgcatatgttgatgcacacggatctagatgtaactcaacaggattatgttagaactgccaggccagtgg

SEQ ID NO: 479 - DNA, 412 bp, Pinus radiata
ggaagtccccttgcacgaattggcaacggcgcgcgtgttttgtttcggagtctttgaagtggacgccgaaacgggggagctgcgcaagcaagggctgcacatccgcttgcaggggcagccaactcagattcttctgatgctgctgaaccgggccggagacgtggtcagccgcgaggagatctgccgccggttgtgggcgtccgatacctttgtcgattttgaccagagtcttggcacggcactcaggaaactccggcaggcgctttgcgatgacgccgagactccgcgttacatcgaaacgattccgaaaaagggctttcggtttgtcgcgccggtagagagaatctctgcgccgcgtcgaggggcaaccgccgtgttgcccatccgcgcgataaacaaaaaaaaaaaaaaa

SEQ ID NO: 480 - DNA, 466 bp, Pinus radiata; identical to SEQ ID NO: 65

SEQ ID NO: 481 - DNA, 342 bp, Pinus radiata
ttaacactgggcttcttcagaatcttacttgcagaggactttataaaccacattataagagtattctgacaattaccattaccatataccccacagaatagagtgagtatttgggttcccagcttctgcacaatctgtcatgttttgggtttattgagatggttgcatctcaatatctctgtcatgttttgggtttattgagatggttgcatctcaatatctgtttttgagtgctcaacacctaaatgggacagagggtgaagacagtctgtactttttgagagcagggttgaagtgggtcctgcagataatgggtgttgctctggtggcctgtttggctat

SEQ ID NO: 482 - protein, 73 aa, Eucalyptus grandis
HEEGGKICDDSIVVSDEEASNDMRRVERFVMIALWCIQENPALRPTMKKITQMLEGAVEVPVPPFPSSFMSSI

SEQ ID NO: 483 - protein, 215 aa, Eucalyptus grandis
RTPLDWENRLKIAIATGRGLAHLHAAGKVVHGNIKSSNVLLRPDHNACVSDFGLNPLFGTAAPPNRVAGYRAPEVVETRRVTFQSDVYSFGVLLLELLTGKAPNQASLGEEGIDLPRWVQSVVREEWTAEVFDVELMRYQNIEEEMVQLLQIAMSCVAVAPDQRPPMVEVVRMMEEMNRGETDDGLRQSSDDPSKGSDGQTPPTESRTPPIGITP

SEQ ID NO: 484 - protein, 134 aa, Eucalyptus grandis
VKINEGFDRFFERELEILGSIKHRHLVNLRGYCNSPTAKLLIYDFLSGGSLDEALHERSEQLDWETRCNIIVGAAKGLAYLHHDCSPRIIHRDIKSSNILLDGNLEARVSDFGLAKLLEDEESHITTIVAGTFG

SEQ ID NO: 485 - protein, 133 aa, Eucalyptus grandis
GMLGVKSDIYSLGIIFLQLLTAKPPMGLTHHVERAIENGTFAEMLDPAVPDWPYNEALAFAQMALKCAELRRKDRPDLAKVILPELDRLKALAERRIHPSWPGYNSSDSPNDSQVSLQLGSMSSPSLGESHCS

SEQ ID NO: 486 - protein, 116 aa, Eucalyptus grandis
LDSDYQPKVADFGLSKLMDRGKVRNSDFSRIRGTRGYMAPEWISNLPITSKVDVYSYGIVMLEMVTGISPMTSVQSLPSGGDAKQIWLVPWVRNKIKGPRRTGSRLKEMVHPELRG

SEQ ID NO: 487 - protein, 143 aa, Eucalyptus grandis
GKPALDWSRRKRIALGTARGLVYLHEQCDPKIIHRDVKAANILLDEDFEAVVGDFGLAKLLDHRDSHVTTAVRGTVGHIAPEYLSTGQSSEKTDVFGFGILLLELITGQKALDFGRVANQKGVMLDWVTKTQKDGKLNQLVDK

SEQ ID NO: 488 - protein, 122 aa, Eucalyptus grandis
DALSGLKILDISNNKISGEIPQTLAGWKSLEIVDLSSNNLSGTLNDAITKWSSLKYLSLARNMFSGNLPSWVFTFQAIRMMDFSGNNFSGIIPDGNFNLSLYYNNRDFARQPGNISLVSMEP

SEQ ID NO: 489 - protein, 75 aa, Eucalyptus grandis
FAKKPVPVKKAIKLPTNLTSYSIADLQMTTGSFSVDNLLGEGSFGRVYRAQFDDGKVLAVKKLDSTALPNELSEE

SEQ ID NO: 490 - protein, 111 aa, Eucalyptus grandis
GLPNICEFNGEYSVAAAAAAAMTVPTGRKEANGGGARNLVFFGKMARAFDLEDLLRASAEVLGKGTFGTSYKAVLEMGNMVAVKRLKDVNIAVGEFKEKIEAVGAMNHEHL

SEQ ID NO: 491 - protein, 197 aa, Eucalyptus grandis
MEAFPKLDPRSFLLLCACALPALALSFPFSPLDNYLLNCGSSVDAVVDNRAFLGDAPGSGGSRVLASTRTISLNDASPALGTPQIYHTARAFARPSKYVFEVRDRGTHMVRLHFHRFDSSRVELGDVRFHVLVDGYVVLSNFSGESASRPVIKEYLIWVDAEKLVLTFVPAGRSKFGFVNAIEVISAPKDLILETAQ

SEQ ID NO: 492 - protein, 205 aa, Eucalyptus grandis
TITHVNLVRLRGFCSEGDKRLLAYDFMPNGSLEYHLFHRKDLKTLDWKTRYQIALGTARGLAYLHEKCRDCIIHCDIKPENILLDAEFCPKVADFGLAKLVGREFSRVLTTMRGTRGYLAPEWISGVAITAKADVYSYGMMLFEFVSGRRNAELSENGAVKFFPTSAASKLAEGGDLLDLLDPNLEANADTEELTRLCRVACWCV

SEQ ID NO: 493 - protein, 150 aa, Eucalyptus grandis
CVSDVGLTPLMNLSAITPRVIGYYAPEVIESRKVTQKSDVYSFGVLLLEMLTGKTPLKHPGLDDVIDLPRWVRSVVREEWTAEVFDVELLKYENVEEEMVQMLQIALTCVTKVPDMRPKMDEVARLIDEVREPEAKDRPSSGAESNAQTP

SEQ ID NO: 494 - protein, 119 aa, Eucalyptus grandis
AKYRIVMGVARGLCFLHHDCYPAIPHGDLKSSNVVFDENMEPRLTEFGLTYLVRMNKGSMGGTVSNLEADNNAIREQLQMDVYNFGEIILEILTNGRSANAVGSIRSKPRDVLVREILI

SEQ ID NO: 495 - protein, 134 aa, Eucalyptus grandis
MLTPQSDVYSFGVVLVELLTRKKLSVTESEKSINIIQCFISSVKGDTPSDVIDFEGASEDEIERVRTVAKIAVKCLDQSGANRPAMSHVAQQLASVNPSSIVEEENEEPKREVDAEELSSCLSCLGMDSASFCI

SEQ ID NO: 496 - protein, 130 aa, Eucalyptus grandis
TSYKEEQQISGPFSFQTDSTTWVADVKQATSVPVVIFEKPLLNITFADLLSATSNFDRGTLLAEGKFGPVYRGFLPGGIHVAVKVLVHGSTMTDQEVARELEYLGRIKHPNLVPLTGYCLAGDQRIAIYD

SEQ ID NO: 497 - protein, 155 aa, Eucalyptus grandis
FLDPIGRGGFGDVYKGELSDKRVVAVKCLKNVAGGDAEFWAEVTIIARMHHLNLVRLWGFCAEKGQRILVYEYVPNGSLDKFLFRSSRATDQSETGEAAAGTDQKPMLDWGVRYRIALGVARAIAYLHEECLEWVLHCDIKPENILLGDDFCPKI

SEQ ID NO: 498 - protein, 113 aa, Eucalyptus grandis
ISNLSNLLQLDVSQNGLTGVLPEKIAAYPFTSLNLNDNLFNGEIPAVLASNPKLQQLKLFNNSFTGKLPADLGKNSDLVEFDVSSNSFTGELPENLCSGGKLQEIMASTIASQ

SEQ ID NO: 499 - protein, 116 aa, Eucalyptus grandis
GNRVARIQIGMRGVSGTLPPDISSLTELTRFEVMNSQFSGPLPSFAGLAQLQVLLLNRNNFTSIPADFFTGMSSLQAVDLSYNDFAAWGIPASLKDCISLQNFTATQANVIGQIPD

SEQ ID NO: 500 - protein, 171 aa, Eucalyptus grandis
RLQICTGAARGLHYLHTGAKQTIIHRDMKTTNILLDEKWVAKVSDFGLSKVGPTSVSKAHVSTVVKGTFGYLDPEYYRRQQLTDKSDVYSFGVVLFEVLCARPAVNRTAQKKQISLAAWAQSCCKSGSIDKIVDPHLKGAIAPECLNKFCEIAMSCLQDEGTKRPSMNDVV

SEQ ID NO: 501 - protein, 208 aa, Eucalyptus grandis
RMRQTGAVEHENLVGLRAYYYNKDERLLVYEYLPIGSLSALLHGNSVVGRTPLNWDTRCDIALGAARGIAHLHSQDAVTSHGNIKSSNVLLTKSYKARVSDFSLAPIANLIAAPNRIDGYRAPEVTDYHKVSQKADVYSFGVLLLELLTGKAPTHSLLNEEGVDLPRWVQSVVKEEWTAEVFDDELLRYQDVEEDMVELLQLAMHCAA

SEQ ID NO: 502 - protein, 197 aa, Eucalyptus grandis
GSLFWLLHGNRGVGRTPLDWTTRLKLAVGAARGLAFIHSSCKSLKLIHGNVKSTNILIDHAGNARVSDYGLSIFASPAAAPRPNGYRAPEVTDGNRGGGGVGKITQKSDVYSFGVVLLELLTGKCPSVPDHGSGAEYGSGAVLDLPRWVQSVVREEWTAEVFDLELMRYKDIEEEMVGLLQIAMACTCASPDQRPRM

SEQ ID NO: 503 - protein, 151 aa, Eucalyptus grandis
ARGDTRRKIIMGVARGMLYLHEDSPLRIIHRDLKASNVLLDSEMNPKISDFGMARLFELDQTRAKTNRIVGTYGYMAPEYPRHGTFSIKSDVFSFGVLVLEMVSGQRNALFRMGDDTEVLISYVWKNWREGSLSNIIDPSILLGQILEIAR

SEQ ID NO: 504 - protein, 137 aa, Eucalyptus grandis
GRRNLELSENGAIEFFPTWAASKIAKGGDLLDLLDPDLEKNADTEELNRICRVACWCVQDEETHRPSMGLVVQVLEGLLDVNLPRIPRALQLLLDNQEHVVFFTESSSSDQNSQTNSNTSTSSLQNPNSSSSTKSES

SEQ ID NO: 505 - protein, 107 aa, Eucalyptus grandis
LAKFTVGVLSDNTKVAVKRLSDHNSPGGETAFVREVELISVAVHRNLLRLIGFCTTFSERILVYPYMKNLSVAYHLRDLKPGEKALAWPTRKRIAFGAAHGLEYLHE

SEQ ID NO: 506 - protein, 169 aa, Eucalyptus grandis
ERGLGLRSFEESTTVVRFAFEDIKKATRNFSRDYIIGRGGYGNVYRGLLQDGTEVALKRFKNCSAAGDANFAHEVEVIASVRHVNLVALRGYCIATTQYEGHQRIIVCDLMRNGSLHDHLFGSTEIKLSWPTRQRVALGTARGLAYLHYGAQPGIIHRDIKASNILLDE

SEQ ID NO: 507 - protein, 153 aa, Eucalyptus grandis
NDCNPSIIHRDIKTTNILLNENMQAKISDFGLSRPSAAANGSYMSTSPLGTCAYLPPEYEPVAHEINKKSDVYSFGIVLLELISGHVVINTMGDGKSVHICEWAIPKFKKGNIRRLIDPKVEEKFDIDSAKIAAKVAESCRNKNQMPGPTYIG

SEQ ID NO: 508 - protein, 142 aa, Eucalyptus grandis
VLRANADLAGDKQALLDFADNLPHSRYLNWTESSPVCSNWVGVTCDKDGSRVIALRLPGVGFHGPIPANTLGRLSDLQILSLRSNAITGSFPSDFANLKNLSYLYLQSNKFSGPLPWDFSVWKNLTILNLSNNAFNGSIPSS

SEQ ID NO: 509 - protein, 156 aa, Eucalyptus grandis
KIGEQRWDMPSLQMLNLARNGFSGNLPEDFGSETLENLDLSENGFSGTIPRSYGTISELMQLNLNNNKLFGNIPEELSSCKKLVTLDLSSNQLSGPIPASISNMPVLGDLDLSENGLSGKIPSNLGNVQSLVQVNISHNRLRGSLPPTGAFLAINP

SEQ ID NO: 510 - protein, 365 aa, Eucalyptus grandis
HLLVCLGSNHAEKFVKILHDSSLNFKYSTLEKATGSFDSANKLGQGGFGTVYKGVLPDGREIAVKRLFFNNRHRAADFYNEVNIISSVEHKNLVRLLGCSCSGPESLLVYEFLPNRSLDRFIFDANKGKALNWEKRVDIMVGTAEGLVYLHENFKNKIIHRDIKASNILLDSKLRAKIADFGLARSFQEDKSHISTAIAGTLGYMAPEYLAHGQLTEKADVYSYGVLLLETVTGRQNNRSKNLEYSESLITIAWNHFQANRVEELFDPSLMLHNHHNRNIKNEVLRVIHIGLLCTQEAPSLRPTMSEALQMLTKKNEELPPPTNPPFIDERTMELNDACDDPSFPLNPKTSDSIATISNSSFQPR

SEQ ID NO: 511 - protein, 280 aa, Eucalyptus grandis
LRSIFILAGLVFIVGVGWFYMKYKSFKNAKRAIDKSKWTLMSFHKLGFSEDEILDCLDEDNVIGTGASGKVYKVVLSSGDAVAVKKLWDGPRKESESHDVEKGHVQDDGFDAEVKTLGKIRHKNIVKLWCSCTTRDCKLLVYEYMPNGSLGDLLHSSKGGLLDWPTRYRIAVDAAEGLSYLHHDCVPPIVHRDVKSNNILLDADFGARVADFGVAKVVERTGKGHESMSVIAGSCGYIAPEYAYTLRVNEKSDTYSFGVVLLELVTGRRPVDPEFGEKDL

SEQ ID NO: 512 - protein, 145 aa, Eucalyptus grandis
VAFYVLIALAVCVVLLFASLVWFLRTKLHWFGGKSRRLWKITTFQRVKFSNEIVDQLIEENKIGSGGSGEVYRIRLKSGQMVAVKKLWAKTQAPDIESMFKSEVETLGHVRHANIVKLLFTCSAEESSLLVYEYMENGSLGDVLH

SEQ ID NO: 513 - protein, 99 aa, Eucalyptus grandis
FGGPIPANLGNLPEKVYIDLTYNNLSGPIPQNGALMNRGPTAFIGNPGLCGPPLKNPCSPDTTGATAPTFPYFPSNYPPQSDDSARGSGKARGLSKSAI

SEQ ID NO: 514 - protein, 95 aa, Eucalyptus grandis
SFGENKDIVKWVIEVALSAPEAEGDGNRDGGEPGCCFGDLAQLVDPRLSPSSSDYEEIEKVLNIALFCTSALPNSRPTMRRVVELLKDKKFARSK

SEQ ID NO: 515 - protein, 232 aa, Eucalyptus grandis
VCSIVFAIAAILKARSLKKAGESRAWKLTAFQRLDFTCDDILDSLKEDNIIGKGGAGIVYKGAMPNGDQVAVKRLPAMSRGSSHDHGFNAEIQTLGRIRHRHIVRLLGFCSNHETNLLVYEYMPNGSLGEVLHGKKGGHLHWDTRYQIAVESAKGLCYLHHDCSPLIVHRDVKSNNILLDLNYEAHVADFGLAKFLQDSGTSECMSAIAGSYGYIAPEYAYTLKVDEKSDVY

SEQ ID NO: 516 - protein, 146 aa, Eucalyptus grandis
PQLEVLQLWENNFTGSIPEKLGANGKFHFLDLSSNKLTGTLPPDMCKGNKLSTLITLGNFLFGPIPESLGECRSLSRVRMGDNFLNGSIPKGLFGLPMLSQVELQDNYLEGEFPVTDGSVAASLGQISLSNNLLSGSLPPSIGDFS

SEQ ID NO: 517 - protein, 189 aa, Eucalyptus grandis
CSRGKLQKVIVFNNRFTGRLPSSLASCDSLEYVRISNNGLSGEVPPGFWGLQAVSYLDMSYNKFEGAISRSISGPMGLKSLLIAGNKFSGDIPAEICQLSNLTVVDVSNNQFGGGLPTCITNLGNLQKLKMQGNLLTGPIPSSVGPWADLTELNLSNNRLTGSIPAQLGDLPVLRYLDLSGNSLSGEIP

SEQ ID NO: 518 - protein, 281 aa, Eucalyptus grandis
LRPDTLSKKNIPESADLNSTCGKAHCPNRLSGRRAGVVLGVVAVVAAIGFAVVGFLTFSWHQHRKQRNSSSLDVLDKRVRASRALENRSKRASALISLEYSNGWDPLAKGGGGSAFSQEVFENFMFNLEDVERATQSFLESNLLEKSSFSSVHRGILRDGSTVTVKRYAKMNCKSDEAEFLKGLKLLTKLKHENLVRLRGFCCSKGRGECFLIYELVPNGNLLQYLDTKPGSGKVLEWHTRVAIIIGIAQGISYIHEDEGDKPRLVHQSISAEKVLIDYWN

SEQ ID NO: 519 - protein, 185 aa, Eucalyptus grandis
GWVGVTCDGTNSSVVELRLPAVGLVGPVPEGTIGGLSQLQVLSLRSNRLSGSVPSDFSNLTLLRSLYLQGNSFAGGFPPGLTQLTRLIRLDLSSNNFSGQIPFGVNNLTRLTRLFLQNNQFSGSLPSISAGGLTDFNVSNNRLNGSIPPSLAKFDASAFAGNLALCGGPLQACSPSFFPPPAPPP

SEQ ID NO: 520 - protein, 100 aa, Eucalyptus grandis
KYWEEDNVLALVDPKISVGCSEIEIIRCINVGLLCTQELANDRPTISTVISMINNEIVGLPRPNKPAFTERQTTTDTGSSRQSQKKYSANNVTITALEGR

SEQ ID NO: 521 - protein, 121 aa, Eucalyptus grandis
MEDSADAQYERKERAALVIIVVLASLALASLLVAFSYYCYIRNKVSKRLKKARGFNDAEKSGFGDLQIASENGLQVFTFKQLHSATGGFSKSNVVGHGSFGLVYRGVLSDGRKVAIKFMDQ

SEQ ID NO: 522 - protein, 156 aa, Eucalyptus grandis
LSPLLSPPPPPQTHFRNLAIAPESSLTVMNGNLQAVVAAAASFVGVSLFFVLLAYACSRRRRRLDRAREARNRTRSISNPDEELAATAVEQNASFDSKIKITMDELRKATKNFHPKKIIGDGGFGLVYKAILADGGGGRTVAIKKLEPDAFQGFRE

SEQ ID NO: 523 - protein, 105 aa, Eucalyptus grandis
DLSFNNLSGKIPESYRSLENIGYPYLTGNQLTGAVPDWILVKGKNVDLSYNNFTSGGSECQERSVNLFASSEVENATSYSATSGLVSYLQSPHCTKNRYKLFINC

SEQ ID NO: 524 - protein, 70 aa, Eucalyptus grandis
TVKRTQEISLPLSLSLSSGFFFCQHHPNLVKLEGYYWTSSLQLLIYEFVPSGSLYKHLHDANEKNSLTWR

SEQ ID NO: 525 - protein, 143 aa, Eucalyptus grandis
VAIKDVEATVAERKFRAAVLRVGSIHHKNLIRLEGYCCESIHRYLVYEYAKNGSLEKYIEDPELSKRLTWKKRMEVCLSVAKTLSYLHSECREFISHGNLKCENILLDENLDAKVSEFGLSIIHGEALSPDTSAERDVEDFGK

SEQ ID NO: 526 - protein, 162 aa, Eucalyptus grandis
ARNGLSGQLPGELSKLTRLEYLDLSSNKFSGEIPANLPPSLVVFNVSHNELSGKVPENLHRFPRSSFEPGNPLLNLGKHFPSANSNGQNNNSDKHGSSKSNIRVAIIVASVGAAMMIIFVLWAYRRAQHKEFHGRSGFSGQSSGRDVKLERFARPSLFKFHS

SEQ ID NO: 527 - protein, 170 aa, Eucalyptus grandis
SSTKLTDLNLSGNNFTGSIPLEENLGNSSVGSAQNFSLSIIDLSNNSLRGSLPREIDRFHNLVYLDLSRNYLEGNLPNDLPDELQGFNVSHNNFSGTVPENLRRFPDSAFHPGNSLLVFPYSPKSPEGPPDRIERPRGHRLRTAIKIALIAGLVGGAWMIAILCFIISRS

SEQ ID NO: 528 - protein, 149 aa, Eucalyptus grandis
FSGEIPKSGGVSSTPSMRGTVCYIAPEYGGGGDLSEKCDVYSFGVLLLVLIAGRRPLQVTSSPMSEFQRANLLSWARHLARSRKLVDLVDQSIQSLDREQALLCITVALLCLQKSPIRRPSMKEVVAMLTGVSEPPQLPSELSPSPPTS

SEQ ID NO: 529 - protein, 149 aa, Eucalyptus grandis
LYGFCCSQSSNLLLYEYMANGSLGEQLHSSEQVCLLDWNDRYKIALGAAEGLCYLHYDCKPQIIHRDIKSNNILLDELLEAHVGDFGLAKLSDSFSKSMSAVAGSYGYIAPEYAYTMKVTEKCDIYSFGVVLLELITGKTPVQPLEQGG

SEQ ID NO: 530 - protein, 140 aa, Eucalyptus grandis
QGGRVLTPSCNVRYEVSPFYDASALPPPQPRLPAPAPPPPAPMTGPTGSFVFAPVPPPLAPMTGPTGKSNKSTMMTVTITVFVGVMVLLFLTCCLLRRKGMKTYEVVTGKSATNELITRESLKFDLATIQSATNDFSPEN

SEQ ID NO: 531 - protein, 150 aa, Eucalyptus grandis
ENASTGSGYTSKLFTDARYISQSMKLGALGLPPYRTYSLEEIEEATGNFDTSAFIGEGSHGQMYRGQLKNGSLLAIKCLKIKKSQSIQHFMHHIELISKLRHRHVVSALGHCFECYWDDSSVSRIFLVFEYVPNGTLRSWISGRRGRQSL

SEQ ID NO: 532 - protein, 166 aa, Eucalyptus grandis
DDEGTVPHHVSTIVKGTPGYLDPEYFLTHKLTDKSDVYSLGVVFLGLLTGMQPISHGKNIVREVNMAHRAGMMFSIIDSRMGSYPSECVERFVALALLCCYDNPEKRPSMLDVVRELESILKMMPDADAILSETASDYSGKSLPSSSSYASMDPYISSSVSGSDLI

SEQ ID NO: 533 - protein, 164 aa, Eucalyptus grandis
EYLHSLAQQSFIHRDLKPSNILLGDDMRAKVADFGLVKNAPDGKYSVETRLAGTFGYLAPEYAATGRVTTKVDVYAFGVVLMEIITGRKALDDTMPDERAHLVTWFRRVLINKENIPKAIDQTLDPDEETLESIIKVAELAGHCTAREPFQRPDMGHAVNILGP

SEQ ID NO: 534 - protein, 328 aa, Eucalyptus grandis
VKRMESGVISEKGFNEFKAEIAVLTKVRHRHLVALLGYCLEGNERLLVYEYMPQGTLSRHLFNWKDEGLKPLEWTRRLSIALDVARGVEYLHGLAHQTFIHRDLKPSNILLGDDMRAKVADFGLVRLAPEGGKGSIETRLAGTFGYLAPEYAVTGRVTTKADVFSFGVILMEMITGRRALDETQPEDSVHLVTWFRRMHLNKDTFRKAIDPVIDLDEETLASVSTIAELAGHCCGREPYQRPDMGHAVSVLSSLVELWKPSEPDSEDMYGIDLEMTLPQALKKWQAYEGNSNIDESSSSFLASNESTQTSIPTRPSGFASSFTSADGR

SEQ ID NO: 535 - protein, 112 aa, Eucalyptus grandis
SYAWKLFQEGKSLDLVDSSLVKYNPDEAAMSIQLGLLCCQASYGDRPDMNSVHLMLSSDSFTLPRPGKPGIQGRTARWTTTSSSAFTKTNPSSTQTGGTKVSTGSSFCRGVF

SEQ ID NO: 536 - protein, 172 aa, Eucalyptus grandis
LHRDIKSSNIMLDSDFNAKLGDFGLARLVDHAKGLQTTILAGTMGYMAPDCVYTGKASKESDVYSFGIVLLEIACGRKAIEPRAEESQVLLVDWVRELYGIGRVLDAAESKLGTNFDEKQLECLMVVGLWCSHPDHTARPSIREALNVLDFNAPLPNLSSKLLVPTYIAPLS

SEQ ID NO: 537 - protein, 203 aa, Eucalyptus grandis
LGNKWAKALKKSKGVKVSMFEKSVSKMKLSDLMKATNNFSKHCIIGLGRTGTTYKAVLEDNTLLMVKRLQDSQHSEKEVMSEMATLGRVKHRNLVPLLGFCMAKKERLLVYKYMPNGILHDQLHSLSLDDPSKALEWTLRLKIGIGAARGLAWLHHNCTPRIIHRNISSKCILLDADFEPQISDFGLARLMNPIDTHLSTFVN

SEQ ID NO: 538 - protein, 149 aa, Eucalyptus grandis
PTTSSDVFAFGALLLEVVCGRRPIEPKALPEELILVDWVWEKWRTGAILDVVDSRLKGEFDEIEAVVVLKLGLMCSNNAPESRPTVRQVVRYLEGQVALPETVAAPDADDEKKGKICSASDGNFDDFVHSYRYPTSSFMEKVSTCSSDD

SEQ ID NO: 539 - protein, 165 aa, Eucalyptus grandis
FGGVYEGHLADTNSHVAIKKITPESKQGVKEYATEVKTIRHLRHKNLVELIGWSHERNKFLLVYEYMSNGSLDSHLFKDKMPLPWEKRYNIAQGIALGLKYLHEDLKQCVVHRDIKSSNILLDAQFEAKLGDFGLARIVDHAKGSQTTLLAGTMGYLAPECIYTG

SEQ ID NO: 540 - protein, 188 aa, Eucalyptus grandis
DIDLPLYDFSTIAVATGHFSQTNMIGAGGFGSVYKGNLSMGQEIAVKRLSKGSRQGLEEFMNEVLLIAKLQHRNLVGLLGCCIEGEERMLIYEYMPNKSLNYFIFDDDRSFLLAWKSRFDIVLGIARGLLYLHQDSKLQVIHRDLKTSNILLDADLKPKISDFGLARIFGGNEREARTKRIVGTYGYM

SEQ ID NO: 541 - protein, 167 aa, Eucalyptus grandis
QAETLRRIQYLLDNPPVLSGWKDGTDFCNTEPNSSLTIVCYEESVTQLIIIGENGAPALPQNFSMDSFVTTLVKLPNLKVLTLVSLGLWGPLSGKIARLSSLEIFNVSSNFLYGALPHELSFLKSLQTLILDKNMFSGPLPDWTGKLLNLTVLSLRQNSFNGSLPDA

SEQ ID NO: 542 - protein, 200 aa, Eucalyptus grandis
RDVPLFDLSTVASATNNFSVLNKLGRGGFGSVYKGVMDNGMEIAVKRLSKHSGQGVKEFKNEVRLIAKLQHRNLVRILGCCVEEDEKMLIYEYLPNKSLDTFLFDKTKRLLPDWKKRFEIASGVARGLLYLHQDSRLRIIHRDLKASNVLLDAVMNPKIADFGMARICGGDQMQGNTNRVVGTYGYMSPEYAMEGIFSIK

SEQ ID NO: 543 - protein, 257 aa, Eucalyptus grandis
LRQIKAATENFDVGNKIGEGGFGAVYKGQLSDGTIIAVKQLSSKSKQGNREFVNEIGLISGLQHPNLVKLYGCCIEGNQLSLIYEYMENNCLSRALFGKDATRKLKLDWPARWKICLGIARGLAYLHGESMLRIVHRDIKTSNVLLDKDLNPKISDFGLAKLNEDGKTHISTRVAGTIGYMAPEYAMRGYLTDKADVYSFGVVALEIVSGKSNTNYRPTEEFVYLLDWVKPPLELLFLPLFAIVHICICFLFSSVMC

SEQ ID NO: 544 - protein, 251 aa, Eucalyptus grandis
LDLSNNRLTGPIPQSLSLEAYNGSFSGNPGLCTAARIKSFKQCSSHPGSSKIIRTVVICFLVASVLLLTSLACFLFIKNREKNGDSKSREESWEVKSFHTLTFTEDEILESIKHENIIGKGGSGNVYKAKLPSGRELAVKHIPTADSSTHGRSLSTSPMLGKGCKRSREFESEVRALSSIRHVNVVKLYCSITSEDSSLLVYEYLPNGSLWDRLHSSGKLELDWKTRYWIAVGAAKGLEYLHHGCERPMIH

SEQ ID NO: 545 - protein, 149 aa, Eucalyptus grandis
AEGLAYLHEESNLRIIHRDIKLTNVLLDKDFTPKIADFGLARLFPEDATHISTGVAGTLGYMAPEYVVRGKLTEKVDVYSYGVLMMEVLSGKKNYSFSESSCSILQTVWNLFGSGRLCEAIDPILEGQFQEQEVSRLLQIGLLCVQASA

SEQ ID NO: 546 - protein, 137 aa, Eucalyptus grandis
NNGRLVHGNVKSSNILINPQQYGCVSDLGLAAVMSSLAPPISRAAGYRAPEVTDTRKAGQPSDVYSFGVVLLELLTGKSPVHATGYGEMVHLVRWVHSVVREEWTAEVFDVELMRYPNIEEELVEMLQIAMACVVRM

SEQ ID NO: 547 - protein, 132 aa, Eucalyptus grandis
PVKNRKASTEPVEYLLVYPLAVNGNVRSRLRECSALQPPLDWPTRMHIALGVARGLSYLHEDCSLLIIHRDIKPSNIFLDENFEPLIAEFGVAKLVNLEDWKQQIQESKSARAPHQMAALDRSEKLYGTQRA

SEQ ID NO: 548 - protein, 161 aa, Eucalyptus grandis
ARFSASRSLADSAAWVSHMSEVASPSPSNDMPEGNNAPQTTEENNTETERGGEEGGHGLTMESEKFSGPKNFSYEELMTAIADRKILGKGGFGAVYEGRIGKARTQVAVKVINYDSHQGMNEYKSEVITLSQLKHKNLVPLIGYCTRRIIGLGYEFMSEGS

SEQ ID NO: 549 - protein, 212 aa, Eucalyptus grandis
GTTLYSDAILNGLEIFKINNPDGNLAGLNTDPDPVPNKLPGPPPASKAPSSLSKAVKIAIVAGGTSGFTILSLLAFFLYRRRNRAKDSTSSDGTSRWGPFSYATTKSTKTQGSSLPSDRCRHFSLTEIRAATNNFDEVFIIGVGGFGNVYKGYVDGGATQVAIKRLNPGSQQGHHEFMTEIEMLSHLRHLHLVSLIGFCNDAGEMILVYDYM

SEQ ID NO: 550 - protein, 62 aa, Eucalyptus grandis
QDHTREQAIKVLRIAVLCTERLPSLRPTMRRVVQMLEDAEPCGPVDIVIEKAGKSGVEGGKS

SEQ ID NO: 551 - protein, 151 aa, Eucalyptus grandis
LTKLTEVGGASLTTRLVGTFGYMPPEYAQCGDVSPKVDVYAFGVVLYELISAKEAILKANGSIAESKGLVALFEEVLNQPDPRENLRKLVDPRLGDDYPLDSVWKVAMLAKACTQENPQPRPSMRSIAVALMTLSSSTEDWDVAPTRTTLW

SEQ ID NO: 552 - protein, 240 aa, Eucalyptus grandis
TIIHRDVKTTNILLDEKWVAKVSDFGLSKTGPTLDHTHVSTVVKGSFGYLDPEYFRRQQLTDKSDVYSFGVVLFEILCARPALNPTLPKEQVSLAEWAAHCHKKGILEHIMDPHLKGKISPECFKKFAETAMKCVNDQGIERPSMGDVLWNLEFALQLQESAEESGKGFGGVGMDDGAFDAAACKGKKDPDVSPGFDSNVSDSRSSGMSMSIGGRSLASEDSDGLTPSAVFSQIMNPKGR

SEQ ID NO: 553 - protein, 148 aa, Eucalyptus grandis
DLGYVAPEYARTLMATPKGDVYSFGVVLLELVTGERPTQVLKAPETFKGNLVEWISELSSSSKLHDAIDRHLVGKGIDDEVFKVLKVACSCVLPAPKERPTMFEVYQFLRAIGDRYHFSTENELMMPIDSGDSDCLEELIVAREATTE

SEQ ID NO: 554 - protein, 195 aa, Eucalyptus grandis
ISNNQKLNEKLEKQFVAEVEILGNIKHRHIVKLLCCISCEKSKLLVYEYMENSSLDRWLHKKKRSSPISGVSNNMILDWPKRLQIALGAAKGLCYMHNDCSSPIIHRDVKSSNILLDSEFNAKIADFGLARMLAEPGEAVSMTAVAGSFGYLAPEYAHTTRVNEKIDVYSFGVVLLELTTGREANDEDEDMCLAD

SEQ ID NO: 555 - protein, 144 aa, Eucalyptus grandis
HQVGIAAGGSVLLLALTAFLMWKRKTSLNPHIRNTEPQGARERSQDFLLNEVVISSKREYSRENKPEELELPLFAFNAIALATKNFSDENKLGQGGFGCVYECRIEEGPVVAVKRLSKNSGQGMEEFKNEVQLIARLQHRNLVR

SEQ ID NO: 556 - protein, 165 aa, Eucalyptus grandis
QTLPAGSSGGYLGLTNAATDGLPSNHLLAIEFDTFNQSYDPDANHVGLDINSVHSNQTVSLANLGFQLAPNGTKFFHVWIEYDGGQKILEVYMTDEDQSTPTKPKPGSPIMTASLDTSKVVSQNSYFGFAAATGDNVELNCVLGWNLTVEELPKGTPRGLVIGLA

SEQ ID NO: 557 - protein, 93 aa, Eucalyptus grandis
FGDGVDIVRWVKTASDPLPQPPSDAALVLAVIDRRLGGYPIASVIHLFKIACRCVEEESSERPTMREVVHMLTNPPLSATTFAVGATPDLIKL

SEQ ID NO: 558 - protein, 122 aa, Eucalyptus grandis
QNSGKFLNWEQRFNIALGTARGITYLHEECRDCIVHCDIKPENILLDENHNAKVSDFGLAKLINAKDHRYRTLTSVRGTRGYLAPEWLANLPITSKSDVYSYGMVLLEIVSGRRNFYVSMEP

SEQ ID NO: 559 - protein, 121 aa, Eucalyptus grandis
LHNRPKGMALNLDWETRKKIAIDSARGLAFLHHSCIPHIIHRDIKSSNVLLDENFVARVSDFGMARLVSALDTHLSVSTLAGTPGYVPPEYYQSFRCTTKGDVYSYGVILLELLSGKRPID

SEQ ID NO: 560 - protein, 114 aa, Eucalyptus grandis
FREMAVATDNFNRSTQVGQGGYGKVYKGNLYDNTVVAVKRAEEGSLQGQKEFLTEIKMLSRLHHRNLVSLVGYCDEEGEQMLVYEFMPNGTLRDWLSGKTKEYLNFSMKLRIAL

SEQ ID NO: 561 - protein, 333 aa, Eucalyptus grandis
FNLPQATIIELNDNLFSGELPAQMSGENLVILSLSNNRISGEIPPAIGNFSGLRTLLLDANRFSGKIPSELFSPRFLLRVNISGNSISGRIPGSVTGCTSLAALDLSRNNLAGEIPNGLSSLKVLAVLNLSSNRLTGPVPKEIGIMTSLNTLDLSFNDLSGEVPHEGQFLVFKNSSFAGNQKLCSPGRFSCPSRSSASRTSSRVVITAISLVTAALLITVTVYQVLKRRRQGSRAWKLTAFQKLGFKAEDVLKCLEEENIIGKGGAGIVYRGSMPNGTDVAIKQLAGRGGNGLSDHGFSAEIQTLGRIRHRNIVRLLGYLSNKDTNLLLYEYM

SEQ ID NO: 562 - protein, 169 aa, Eucalyptus grandis
VYKAEMPGGEILAVKKLWGKQKEHLRRRRGVLAEVEVLGNVRHRNIVRLLGCCSNRECAMLLYEYMPNGNLDDLLHGKNKDQNLGADWVIRYKIALGVAQGICYLHHDCDPLIVHRDLKPSNILLDAEMEARVADFGVAKLIQSDESMSVIAGSYGYIAPEYAYTLQVD

SEQ ID NO: 563 - protein, 135 aa, Eucalyptus grandis
FNSLMVLALGNCALRGQIPVWLLSCPKLQVLDLSWNHFDGSIPFWMGKMENLFYLDLSNNSLSGEIPKSLTELKCLVSPNSVSPNLTASAGIPLYVKRNKSANGLPYNQVSSFPPSMYLSNNRLNGTIWPEIGQL

SEQ ID NO: 564 - protein, 158 aa, Eucalyptus grandis
SKRKDGSNVLKVKGTNGTSQNPKDFGSGVQEPEKNKLVFFEGCSYNFDLEDLLRASAEVLGKGSYGTAYKAILEDGTTLVVKRLREVAAGKKEFEQQMELVGKVGRHANIVPLRAYYYSKDEKLLVYDYMPYGSLFVHLHGDKGSGRTPLDWNSRMKI

SEQ ID NO: 565 - protein, 237 aa, Eucalyptus grandis
LKILNLSGNKLNGLVPEALKRRVIDKKLDLSFNDNPDLHWQFEKRNLTILVPVVASVSGVILVICLVTIWLIRRKRIRGMVRLRSFNYGEITRITGNFGTEIGVGGFGKVYLGTLENGTKVAVKMLSEKSWQGDREFQAEEKQLMIVHHGNLVSLHGYCNHSKNKALVYEYMANGNLQQHLHGDKPVLTWKQRLRIIVDVAKGLEYLHNGCDPPIIHRDLKATNILLNEKMQAKISD

SEQ ID NO: 566 - protein, 173 aa, Eucalyptus grandis
VAVKVLRSDACERKEEFLREVEVLSQLRHPHLVLLLGACPESRGLVYEYMENGSLEEYIYQQNGKPSLPWFVRFRITFEVACGLAFLHNSKPAPIVHRDLKPGNILLGRNYVSKIGDVGLSKLISDVVPDNVTEYRDSVLAGTIYYMDPEYQRTGTLRPKSDLYAFGIIILQL

SEQ ID NO: 567 - protein, 124 aa, Eucalyptus grandis
SSPPAPVNGPKGKSNKSTTIIIAAAIPVGIAVILLFVACFWHRSKTTKTYEVVQAEGGTSELTTTESLLYHLATIQAATNNFSHQNKLGEGGFGAVFRGRLPNGQEIAVKKLSKSSGQGVGEFK

SEQ ID NO: 568 - protein, 219 aa, Eucalyptus grandis
AKVSDFGLSLMGPEDDESHLSLHAAGTLGYVDPEYYRLQILTSKSDVYSFGVVLLELLSGYRAIQNNENGVPRNVVDFVIPYILQDEIHRILDRKVLPPNPIEIEAVRYVGYLAADCVSLEGKDRPTITEIVYSLERALATCLARPKLSRSSTESSTAPSSFVVNSTATHHSQAKCAENTILSFFPCLPVSFCTVTFFPSFDSEEGIRAIDVSPTCHLK

SEQ ID NO: 569 - protein, 296 aa, Eucalyptus grandis
YKGKLSNEIFVAVKMLDNSFGNGEEFINEVSTMGRIHHVNVVRMVGFCADGFRRALVYEFLPNESLEKFIFQGEDALDPFLSWERLHDIALGVAKGIEYLHQGCDHKILHFDIKPHNILLDNNFNPKIADFGLAKLCSKEQSAVSMTAARGTMGYIAPEVFSRNFGSVSSKSDVYSFGMLLLEMVGGRKNVDVNAKNMSQMYFPQWVYNHLNKGEELEIRIREDGDHNIAKKLAIVGLWCIHWYPADRPPVKAVVQMLEGDECPVMPKNPFVSSSSGDAAIMRGRLWNTDLEVIAE

SEQ ID NO: 570 - protein, 161 aa, Eucalyptus grandis
RILRLGRNKLRGDFYNSFINCSLLEELDMSFLYLHGTLPDFSPMQSLRILDLSSNLFTGKFPMSVFNLTNLESLNFNENDRFEPWRLPETISQLSKLKSLILMTCMAEGRIPPSIGNMTSLVDLELGGNYLVGPIPKELGLLKNLKQLELYYNQLNGSIPE

SEQ ID NO: 571 - protein, 119 aa, Eucalyptus grandis
MIHSCPTTRIYTGVTVYTFGSNGSMIYLDLSYNFLSGTIPENYGSMGFLQVLNLGHNNFTGQIPDSFGGLKNIGVLDLSHNHLTGPVPGSLGSLNFLNDLDVSNNNLSGLIPSGGQLTT

SEQ ID NO: 572 - protein, 132 aa, Eucalyptus grandis
TLKMLNISYNPFAPGRIPPELGNLTNLEVLWLSECGLTGKIPESLGRLKRLTDLDLAFNYLEGPIPSSLTELESVVQIELYNNSLTGELPAGLSKLTALRLLDASMNRLTGTIPDELTRLPLESLNLYENQF

SEQ ID NO: 573 - protein, 155 aa, Eucalyptus grandis
IICLVVVVVLLSLSLACYVRVYKREKDQERSLKEESWDVKSFQVLTFTEDEILDAIKEENVIGKGASGNVYRVVLNNGRELSVKHIWNTDSASSISSLPPDPTSSRPCSTYPAPSSPPARTCSLRGRRPRPPATSPASPATPPAPSSPSTSPASS

SEQ ID NO: 574 - protein, 120 aa, Eucalyptus grandis
AAHLHRGIFGADSQRQSRLYWFASAIGAVEVLIFFSGWWILFRKHEVQSTLEDGYRAITSQFRRFSYEELKSATQNFKGEIGRGASGSVYKGVLPDERVVAVKRLGDLHHEEIFWAEVST

SEQ ID NO: 575 - protein, 150 aa, Eucalyptus grandis
GQISGPIPEDIGNCSELRNLYLYQNSISGSIPRQIGNLKKLQNLLLWQNSLVGTIPDELGSCTELAVVDFSVNLLTGSIPRSFGNLLKLQELQLSVNQLSGTIPPEITNCTALTHLEVDNNGITGEIPSLIGNLKSLTLFFAWQNNLTGS

SEQ ID NO: 576 - protein, 183 aa, Eucalyptus grandis
RNERAFWCEMSTTGGGDRGPPPAMTAVAVAVKGDLSGFEGGRGSRRAVRWAVENLMPGADRLVLVHVMPRVTSIPTPSGDRIPVAELDGSVVAMYVEETKVKYEQVFVPFKKLCKPWKVETLVLEDDNPAAALLRFVSNVGINNLVLGSCSSNAFARKLKGAAVPATVLTCAPETCDVYVISR

SEQ ID NO: 577 - protein, 173 aa, Eucalyptus grandis
FSVDQDRANTNRVVGTYGYMAPEYAMQGLFSVKSDVFSFGVLLLEIVSGRKNNDFHLQVKGESLLTFAWKLWSEGRALELIDPLIDESCDEVEVLKCIHIGLLCVQEDPADRLTMSLVVHILAGDTITLSPPSLPAFSVGRDAEKLDRASTVNEVTLSVVAASRSSFIQWKCC

SEQ ID NO: 578 - protein, 178 aa, Eucalyptus grandis
EIPGSIFALRNLSKLYVYNTNVSGSIPQSVSAANLSRIDLSFNNLTGNIPEDFGKLKNLSCLSLQFNQLSGGIPEGIGRLPALSDVRLSKNNLSGTIPPDFGKFSPLRRFEVAFNSLTGALPEQLCHGGTLFGLAVMDNNLGGELPESLGNCSTLSVAMLNNNGFTGNVPGGLWMLRN

SEQ ID NO: 579 - protein, 113 aa, Eucalyptus grandis
EQMDVYSFGVVLLELVTGRQAEQKELAESVDIVKWVRRKINLTNGALQVLDPKISSSSQKEMLGALEIALRCTSVAPEKRPSMTEVIRNLQLHGSKGSSPSLEFSASENPMSV

SEQ ID NO: 580 - protein, 176 aa, Eucalyptus grandis
THTSNTDCIGKPGKMVFKFHTIDFTEDVDFNALFAPSPPPSSTVCLPLGKSFTRTMAVAGRAAEGVSCGFTVPAVEVSCWRPKTSYDDSNLQLLHPQVQLRKFTYQELKVATGNFSNLLGRDCWGMIYRGILLDGSVVAIKRYRRASDYAEVCACAEVQILSIARHRNLIQVLGFC

SEQ ID NO: 581 - protein, 119 aa, Eucalyptus grandis
QFLLRTVAGPSLSLCSHLQWLNISSNYFVGQLPDLSPGFADLRFLDLSYNNFTGAFPASFGRLPALSALSLFGNLLNGSIPSFLGNLSQLTQLNIGYNPYAQAPLPSAIGNLSRLENLW

SEQ ID NO: 582 - protein, 175 aa, Eucalyptus grandis
ERSIALFLCASIASLAPAIMLLVQAQINPEGFISIDCGASNPYTDDTTKIYYETDQEFTESGRSMNVSLAAGPRFLETLRSFPDGMRNCYSLKPEQGENKPYLIRASFLYGSYDGKNQTPTFDLYIDVNKWSTINSYYYEKREIVYVAQRDVVQVCVVNIGKGVPFISALELKPL

SEQ ID NO: 583 - protein, 175 aa, Eucalyptus grandis
MKRSSDLTILFWVAWLVTAVAAVEDDIQCLQGLKASLGDPQGKLSSWRFASSSVGFICKFVGVSCWNDRENRILSLELRGMDFTGQIPESLQYCRSLQTLDLSNNGLSGTIPPQICRWLPYLVTLDLSSNGLSGSIPPDLVNCTYLNNLVLSNNRLTGTIPYDFLTLSRLKKFSA

SEQ ID NO: 584 - protein, 149 aa, Eucalyptus grandis
VQEATNNFDESWVIGIGGFGKVYRGDLNDGTRVAVKRGNPRSQQGLAEFQTEIEMLSQFRHRHLVSLIGYCDEKSEMILIYEYMENGTLKSHLYGSSVPSLSWNQRLEICIGSARGLHYLHTGYAKAVIHRDVKSANILLDENLMAKVA

SEQ ID NO: 585 - protein, 93 aa, Eucalyptus grandis
IYRDFKASNILLDLEYNAKLSDFGLAKAGPTGDRTHVSTQVMGTQGYAAPEYIATGRLTARCDVYSFGVVLLELLSGRRTVDKSKVGVEQNLV

SEQ ID NO: 586 - protein, 116 aa, Eucalyptus grandis
GIPVVIKKVDLRSIRKEVYPVELDFFSKVSHGRFVPFLGHCLESENEKFLVYKYMPNEDLASSLFRKTSSEDDTLQSLDWIKRLKIAVGAAEGLSYLHHECLPPLVHRDVHASSIL

SEQ ID NO: 587 - protein, 181 aa, Eucalyptus grandis
GEQRYKEFVAEVQAIGRVKHPNVVKLRAYYWAPDEKLLISDFISNGNLASALRGKSGQPSSSLSWSTRLRIAKGTARGLAYLHECSPRKFVHGDVKPSNILLDNEFQAYISDFGLNRLISITGNNPSSGGFIGGALPYFKSVQPEKANNYRAPEARVPGSRPTQEVGHLLRSGLSCSSFFF

SEQ ID NO: 588 - protein, 158 aa, Eucalyptus grandis
NRNIQIVIAAAAGFICASLFFIFLAFTCSRRKRNRGRELQVQTGCMPEELSSIAVDGSAFFDPKLRISMAELRTVTKNFHPKKIIGDGGFGLVYKGRLANGLTVAIKKLEPDAFEGFQEFMAEMETLGKLQHPNIVKLLGYCMSNSDRVLVYEFIERG

SEQ ID NO: 589 - protein, 98 aa, Eucalyptus grandis
SEQSLVRWATPQLHDIDSLAKMVDQALKGIYPAKSLSRFADIIALCVQPEPEFRPPMSEVVQALVRLMQRASLNKRRSSDEPGASHRQLDHDPSDISI

SEQ ID NO: 590 - protein, 50 aa, Eucalyptus grandis
SPLPINRPSMRRVVKMLQEISAENAPKKVIKDGKLTPYYYDDASDPGSVA

SEQ ID NO: 591 - protein, 145 aa, Eucalyptus grandis
LDWITRLKIAIGAAEALSYLHHECYPPLVHRDVQVGSILLDDKFEVRVGSLSEVRAQDEDSHGNVITRLLRKPQTSEQALSGSSSANCAYDVFCFGKVLLELVTGKLGISKSDDATTREWLEHTLSYISVHDKELVTKIMDPSLI

SEQ ID NO: 592 - protein, 129 aa, Eucalyptus grandis
LAAILKAKSFKKSSSGSWKMTAFQKLDFTVSDVLECVKDGNVIGRGGAGIVYHGKMPNGVEIAVKKLLGFGNHSHDHGFRAEIQTLGNIRHRNIVRLLAFCSNKEANLLVYEYMRNGSLGEALHGKKGT

SEQ ID NO: 593 - protein, 249 aa, Eucalyptus grandis
ELGRGGFGAVYRTVLRDGRAVAIKKLTVSSLVKSQDEFEKEVKKLGKIRHSNLVALEGYYWTPSLQLLISEFVSGGNLYKHLHEGSGGNLLSWNERFNIILGTARGLAHLHQMSIIHYNIKSSNILIESSGEPKVADFGLARLLPMLDRYVLSSKIQSALGYMAPEFACRTVKITEKCDVYGFGVLALEIVTGKRPVEYMEDDVVVLCDMVRGALEEGRVEECIDGRLQGNFPSEEAIPVMKLGLICTS

SEQ ID NO: 594 - protein, 164 aa, Eucalyptus grandis
QAEKEFRVEVEAIGHVRHKNLVRLLGYCIEGTHRMLVYEYVNNGNLEQWLHGAMRQQGYLTWEARIKVLLGTAKALAYLHEAIEPKVVHRDIKSSNILIDDEFNAKVSDFGLAKLLGEGKSHVTTRVMGTFGYVAPEYANTGLLNEKSDVYSFGWFYLRQSLVE

SEQ ID NO: 595 - protein, 112 aa, Eucalyptus grandis
GPREQERLLLADYIQGDSLALHLYETTPRRYSPLSFSQRLKVAIDVARCLTYLHDKGLPHGNLKPTNILLMGPEYNVLLSDYGLHRLMTPAGIAEQILNLGALGYRAPELTT

SEQ ID NO: 596 - protein, 164 aa, Eucalyptus grandis
GYCIEGIHRLLVYEYVNNGNLEQWLHGAMRHHGYLTWEARMKILLGTAKALAYLHEAIEPKVVHRDIKSSNILIDDDFNAKISDFGLAKLLGAGKSHITTRVMGTFGYVAPEYANSGLLNEKSDVYSFGVLLLEAITGRDPVDYGRPAPEVNLVDWLKMMVGSR

SEQ ID NO: 597 - protein, 159 aa, Eucalyptus grandis
GIPCDPMVNILLSIARPMGYPVKFAQGWLGNSACNSWTGISCSGGNIVVINFQNMGLSGTIAPEYSNITSLERLLLSHNSLTGTIPSELTTLSNLKVLDVSYNNLSGKVPTFRSNVNIIKDGNPNIGKDIAPPASPTTTPPGSPGGSDNKKSSVARIVA

SEQ ID NO: 598 - protein, 151 aa, Eucalyptus grandis
LDADMRARVADFGLAKQSREGQSHLTTRVAGTHGYLAPEYALYGQLTEKSDVYSFGVVVLETMCGRKALDLSSSGSPRAFLITDWVWSLIKAGKIEEAFDPSLLKAGESTNSNPKGIMERFVLVGILCAHVMVALRPTILDALKMLEGDIE

SEQ ID NO: 599 - protein, 102 aa, Eucalyptus grandis
CFRRRKAAKTHEAVQGDQSGASEISNADSLQYDLATIQTATDNFSHQNKLGEGGFGKVFQGRLPNGQQIAVKRLSQSSGQGAQEFKNEVLLVAKLQHRNLVR

SEQ ID NO: 600 - protein, 126 aa, Eucalyptus grandis
DNLHCSMTMERSITAFSFALLAGLASSLVPVVQAQQIPGFISIDCGATNVYTEDEIRIRYETDEGFIDSGQNKQISMTFIHEGYRQCLNNLRSFPNRKRNCYTLKPDQGKNNTYLIRARFYYGNYD

SEQ ID NO: 601 - protein, 164 aa, Eucalyptus grandis
GTRDNVRLFWAKEKPDCGRCTNRKWCRRKESGTKCIDPPRRHEGKRNLEITGGVVGFFLFLVGLSGLGYFINEKRRDKAFQLKIESFLQDYEALKPTRYSYNDIKRITNDFEEKLGQGAYGTVYKGKLSDEIFVAVKMLDNSFGNGEEFINEVSTMGRIHHVNV

SEQ ID NO: 602 - protein, 309 aa, Eucalyptus grandis
GQFEFQREVQALSKLQHPHLVTLLGSCPESWSLVYEYLPNGSLQDYLFRKGNSSSLLWDARVRIIAEISTALCFLHSSKPERIVHGDLKPENVLLDSDLSCKICDFGISRLVVEDTLRCPSFRRITEPKRAFPYTDPEFYRDGNLTPKSDVYSFGLIILQLLTGEPPTGLVREVHKAKSSNKLESVLDQSAGQWPSSVALRLVDLGLQCCDSNGRNRPKLTPAFVRELEQLHTSEERPVPPFYLCPILQEIMHDPQIAADGFTYEGEAMREWLDNDHDTSPMTNLKLSHLHLTPNHALRSAIQEWLCYP

SEQ ID NO: 603 - protein, 205 aa, Eucalyptus grandis
RGRVDAIVDCKDRWGSTPLADAIYYKKHDVIKLLEENGAKPLMAPMHVKHAREVPEYEINPNDLDFTSSKDITKGTFCLASWRGTEVAVKKFREEVFADEDKVRAFRDELAILQKIRHPNVVQFLGAVTQSSPMMIVMEYLPKGDLREYLTSRRALRPSKAIRFALDIARGMNYLHENKPAIIHRDLEPSNILRDDAGHLKVADF

SEQ ID NO: 604 - protein, 131 aa, Eucalyptus grandis
VRHKRLVNLIGCCAEGDERLLVAEYMPNDTLSKHLFHWEQQPLPWEMRVRVAYYIAQALDHCNTENRKIYHDLNAYRVLFDEDGDPRLSSFGLMKNSRDGKSYSTNLAYTPPEFLRTGRVIPESVIYSYGT

SEQ ID NO: 605 - protein, 213 aa, Eucalyptus grandis
MGIVKFLRSKLLNRRRAAVHVEGGESCSGRCGDAAEAAAVKRLEWGEIERITGRFSVVVGEGGFSTVYMGRLPVCGGGSAAAAAVKVHCGGGERLSLAFKLELEVLLRLKHENIVRILGYCDDADQGALIFEYVSGGTLYDRLHGRSGNKRSTLPWKSRVKIAFQLAQAIEYLHERCIVHIIHGDIKSSNVLLDGDSNCKLCDFGSAKMGFSS

SEQ ID NO: 606 - protein, 133 aa, Eucalyptus grandis
GYTYKVNEKSDVYSFGVVLMELVIGKRPIEPEYGENRDIVNWVSSKLKTRQDVFGIVDSRIPEPFKEEAINVLRIAILCTTKLPNLRPSMRSVVQMLEDAEPCNLVRVVVEKDGDGKAEVTDSKKIKPRAMRA

SEQ ID NO: 607 - protein, 205 aa, Eucalyptus grandis
MAANKLFPVVFSVIFVILSALLPTPCLCYEPRNHEVEALIGVRRELNDPHGVLNNWDEDSVDPCSWAMITCSSDNLVIGLGAPSQSLSGSLSETIRNLTNLRQVLLQNNNISGGIPPELGTLPRLETLDLSNNHLSGPIPESLGQLRSLQYLRLNNNSLSGAFPVSLAKIPLLAFLDLSYNNLSGPVPKFPARTFNVVGNPLICG

SEQ ID NO: 608 - protein, 207 aa, Eucalyptus grandis
TMDQDGNLRLFSLDKQSGSWVVTWQALPGLCNVHGICGRNGICVYTPEPKCTCPPGYEMSEPTDWNKGCKPKFNFTCSKSQDVKFLALPNTDYYGFDAIYNDNASFNFCRQACLDDCSCLGFSYRESQRFCFGKRSLFNGYKQPSFPGTLHLKLPISMVASLEQIRNGSNPDCSKARDQLMVGSSTMYDTISKRVRWAYLYWFASAI

SEQ ID NO: 609 - protein, 129 aa, Eucalyptus grandis
WLHRPEYAYTMKFEKCDIYSLWSRLAGAADGKTPVQPLDQGGDLVTWVRNYIQDHSLSPGVLDVRVDLQDESTVSHMITVLKIALRCTSMSPSDRPTMREVVAKLIESGEKEGKFYCYPSDDTDSRDES

SEQ ID NO: 610 - protein, 54 aa, Eucalyptus grandis
SSFLGNKGLCGEPLTFSCGSSSGPDHEGYRHRVSYRIILAVVGSGLAVFVSVTI

SEQ ID NO: 611 - protein, 162 aa, Eucalyptus grandis
CVTPIIHRDIKTTNILLNENMQAKISDFGLSRGLKAANSTYESSSPLGTPGYLPPEYQPSAYKLNQKSDVFSFGIVLLELMTGQQAMMPGGEGEGVPIRGWAISIIKSGDMHRLMDRRLQGKFDIGSAQIAARVAESCTCEEADTRPDISHVLADLKGAIEL

SEQ ID NO: 612 - protein, 121 aa, Eucalyptus grandis
KSSSPWPFAFPSFLLCLSLCTTHLCLGSGSDTISANQSLPGSQTLLSSGGNFELGFFSLGNSTYSYIGIWYKKVSVPTIVWVANRENPVTDRNATELKISGGNLVMVNDSAVPVWSTNLTA

SEQ ID NO: 613 - protein, 525 aa, Eucalyptus grandis
MAEVVEGGASSHDVQSLLSSPDRDFLIRNNGDQVKVDSLKGKKIGLYFSASWCGPCHRFTPILAEVYNELAPRGDLEIIFISADEDEEAFSRYFSKMPWLAIPFSDSEKRDSLDELFKVRGIPHLVVLDGTGTVLTDSGVEIVREYGVEGHPFTPERVKELKDQEEAAKRNQSVTSLLVDGSRDFVVSSDGKKVPVAELEGKTVGLYFSLSIYKSCIDFTPILLDVHEKLKAKGERFEIVQIPLDDDDESFNQAFGSMPWLSLPLKDKKCEKLVRYFELSTLPTLVIIGPDGKTLRSNVAETVEEHGVEAYPFTPEKFAELAEIQRKKEESQTLESILVSGDRDFVIGKEGTKIPVLDLVGKTVLLYFSAHWCPPCRDFLPVLTEAYEKIKAKNNAFELIFISSDKDQAAFDNYYAQMPWLALPFGDERKKSLNRKFKVDGIPTLIAIGPTGRTLTKEARNLISEHGADAYPFTTEHLKKLEKSTKIELDEEEDEEDDKAAGEEAKEGGEAGEGWVCDGEVCYKA

SEQ ID NO: 614 - protein, 280 aa, Eucalyptus grandis
ASSCGTSNYFFRPCGRSRRIGILIGGLTAGASLMATLAVICFFAHRRSTTQRNQISAKRLLRDAAGNSSLPLYQYKDIERSTNGFSEGQRLGTGAYGTVYAGNIHNDEWVAIKKIRHRDTDSIDQVLNEIKLLSSVSHPNLVRLLGCCIEQGEQILVYEYMPNGTLSQHLQRERGKGLPWTTRLTIAAETARAIAYLHSAVNPPIYHRDIKSSNILLDYQYRSKVADFGLSRLGMTETGDSHISTAPQGTPGYLDPQYHQISICPTRVTSTVLGWSLWKS

SEQ ID NO: 615 - protein, 127 aa, Eucalyptus grandis
VEVTVKKPKDVHKPLMKKGFQDELKIVTQTKYKYVARLYGICLETRIPLLVYEYILNGTLFEHIHLKMSTILRSWENRLRIAAEVALALKEMHSSEIIHGNIKSMNILLDQNYSVKISDFGTSVLIS

SEQ ID NO: 616 - protein, 185 aa, Eucalyptus grandis
EVGLMSLGNLKTFTFKELQLATDNFSSKNILGTGGFGNVYKGKLGDGTMVAVKRLKDVVGTTGELQFRTELEMISLAVHRNLLRLIGYCATSNERLLVYPHMSNGSVASRLKAKPALDWNTRKRIAIGAARGLLYLHEQCDPKIIHRDVKAANVLLDDYCEAVVGDFGLAKLLDHADSHVTTAVR

SEQ ID NO: 617 - protein, 170 aa, Eucalyptus grandis
KRLPHPRKAAGGLPLPSAPADNGFVIYHNLGRNNFTGTLSSMPIIPRRLNAQMIYALFAGENNLSGPFPENIFENCQNLDIIAINISYNKVSAPIPSGMGKSCRSRILLDASRNQIPGSIPPSLGELLSFVGLNLSWNSLQGQIPPSLGQVKGLKYLSLAHNNLTGSIPP

SEQ ID NO: 618 - protein, 135 aa, Eucalyptus grandis
DLSFNDLSGEVPHEGQFLVFKNSSFAGNQKLCSPGRFSCPSRSSASRTSSRVVITAISLVTAALLITVTVYQVLKRRRQGSRAWKLTAFQKLGFKAEDVLKCLEEENIIGKGGAGIVYRGSMPNGTDVAIKQLAG

SEQ ID NO: 619 - protein, 281 aa, Eucalyptus grandis
MTLSLLLSLLFSLAFLHCCRHPPRALSSPLSELHALMALKAALDPSGRVLTSWSRGADPCGGGASFEGVACDERGRVVNVSLQGKGLRGRIPPEIGGLGSLTGLYLHFNALGGEVPGEIGGLRMLTDLYLDVNGFSGEIPPDIANLTNLQVLQLGYNRFSGGIPRQLGSLPKLTVLALQYNRLTGAIPASLGDSANLKRLDLSYNNFFGSIPATLTNASSLEVLDVRNNTLSGYVPTGLKRLDDGFQYENNPDLCGVGFPNVRPCPTVYLDRPEPLRPDTL

SEQ ID NO: 620 - protein, 222 aa, Eucalyptus grandis
VEYLKFLFILETHFTAKRRYCRDLSFYLHHHLLQADLDSSLSPSGFSVLLMNLNTMRLKRGEEAALCLVAFLWIWNSANGLLSPKGVNFEVQALMRIKDCLHDPHNVLENWDKDAVDPCSWTMVTCSTDSLVVGLGTPSQSLSGTLSPSIGNLTNLQIVLLQNNNIMGPLPPELGRLSRLRTLDLSNNFFTGEIPSSLGHLNSLQYMRLNNNSLSGAFPSSL

SEQ ID NO: 621 - protein, 280 aa, Eucalyptus grandis
ISLLPFFCLLSSLSRFADFENLTASSSMKAFVALSMCPVLFFSCNALLSNALDTITTNQSIRDGENLLSAGGTFELGFFSAGNPPKRYLGIWYKKITTTTIVWVANRVAPLADASGTLRITSRGSLVLLNGNGSDIWSSNSTILVRNPVAQLLDSGNLVVRDADGSDPNNVLWQSFDYPTDTFLAGMKIGWNRTSGFNRYLTSWKSIDDPSPGNFTYQIDPNGYPQLLLKQGSDIKFRSGPWNGLRWSGTPNLNPNPYYRYEFVLNEEEMYYRYELLNSS

SEQ ID NO: 622 - protein, 123 aa, Eucalyptus grandis
GTYGYMAPEYAMHGYLTDKADIYSFGIVALEVVSGQSNSSSQKTEECFILLDWAHFLKERGNLIELVDPRLGSHFDKEEALALIKIALMCTYVTPALRPPMSYVVAVLDSAGAIMTEEKLRHE

SEQ ID NO: 623 - protein, 117 aa, Eucalyptus grandis
DSQRLKEFQTEVEAIAKIKHSNIVPLRAYCWSGDEKLLIYDFIPNGDLSAAVHGKAGTTNSMPLSWSTRLRIMKGVAKGIAHLHEFSPKRYVHGDLKPSNVLLGKNMKPFISDFGIS

SEQ ID NO: 624 - protein, 147 aa, Eucalyptus grandis
DDYCEAVVGDFGLAKLLDHQDSHVTTAVRGTVGHIAPEYLSTGQSSEKTDVFGFGILLLELITGQRALEFGKAANQKGAMLDWVKKIHQEKKLEMLVDKDLRSNYDRIELEEIVQVALLCTQYLPAHRPKMSEVVRMLEGDGLAERW

SEQ ID NO: 625 - protein, 191 aa, Eucalyptus grandis
EMSSLMHVDLRNNRISGPIPADFGKLTMLSRALLGRNQLNGTIPSSIATMYRLADLDLSMNHINGWVPEELGKMRVLSTLTLDSNWLSGKLPASLLSDAGMGILNLSRNWIEGEIPDVFGSNSYFMALDLSHNNLKGKIPGSLSSAKYIGHLDLSHNHLCGPIPIGEPFEHLEASSFANNDCLCGNPLRTC

SEQ ID NO: 626 - protein, 166 aa, Eucalyptus grandis
VSDFGLSLLLNPVHAIARLGGYRAPEQAETKRLSQKADVYGFGVLLLEVLTGRAPSQYPSPTRPRADEEEQAVDLPKWVRSVVKEEWTAEVFDQELLRYKNIEEELVSMLHVGLACAAAQPDKRPLMAEVVKMIEDIRVEQSPLGEDYDESRNSLSPSLATTEDGL

SEQ ID NO: 627 - protein, 231 aa, Eucalyptus grandis
MGRGLFLGRGLFLCLLVFCTSVLMELSTAQMPGFVSLDCGGSQSFTDEIGLEWTPDDHFTFGERTNVSLTNETRTQYTTLRYFPADDRKYCYTLNVTTRTRYLIRATFLYGDFDSNNVYPNFEISLGPTFWSTIVISDASTIEVRELIFLASDPTISVCLSNATTGNPFISTLELRQFNGSMYFTGFENQFYLSTSARINFGAESEEPVRYPDDPFDRIWESDSVKRANYL

SEQ ID NO: 628 - protein, 220 aa, Eucalyptus grandis
ARPSSSSGGAREEDGGDGGETALQARSLAQSDLDVLLQLRAALAAPNSTALHDWVGPSSSSSSSSSPPPFPHCSFTGVTCDAGSRVVSLNLTDVRLFGRVPREIGLLRDLVNLTLTSCNLSGTLPPELGNLTELEVLDVYDNNFTAQLPPEVVGLKKLKWLNLAGNYFFGEIPEVYSEMESLEYLGLQANQLSGRVPASLAKLKNLQWLYLATSTRTMAR

SEQ ID NO: 629 - protein, 240 aa, Eucalyptus grandis
MHVTVYRRRGELAAALRLVLRSWSLLCCCCCFFLLPLALAADGDYEILLRVKAAHLEDPDGQLDDWAPNADRSPCNWTGVTCETRNRSVVAIDLSGLNLSGGFPYDFCRIRTLRNLSLGFNFFNGTVVGPSLSLCSHLQGLNISSNIFVGELPDLSPGFTDLRFLDLSLNNFSGEIPASFGRLPALSVLSLVANLLNGSIPSFLGNLSQLTQLNIKLQPVRAGPSASGDRKPVQARESLG

SEQ ID NO: 630 - protein, 124 aa, Eucalyptus grandis
RLLLIVFLSFPSELLEGFISIDCGASNPYTDDTTKIYYETDQEFTESGRSMNVSLAAGPRFLETLRSFPDGMRNCYSLKPEQGENKPYLIRASFLYGSYDGKNQTPTFDLYIDVNKWSTINSYY

SEQ ID NO: 631 - protein, 277 aa, Eucalyptus grandis
MRPFLLLLLLLLLHLRRGAAASAAPTRLTEPLALLSIRAAVTGDPQSALSSWTSAAAANGSSHCSWQGVTCDARRRHVTALDLSSLELAGALSPDVAHLRFLTSLSVAANQLSGPIPPQISALAALRYLNLSNNVFNGTFPPRLGLLRNLRVLDLYNNNMTGDLPVAVAEMPQLRHLHLGGNYFGGRIPPEYGRWEFIEYLAVSGDELTGAIPPEIGNLTTLRELYLGYYNSYDGSLPPEIGNLSQLVRLDAASCGLSGEIPLRLPSCRISTLCFFK

SEQ ID NO: 632 - protein, 182 aa, Eucalyptus grandis
MGFFYQVFLIFLAVAPSALCQVTEFVSIDCGGSSNYTDPTTGLAWIPDTGLMSYGQSSKVQNPNVSSVQYSTRRDFPIDGQKYCYTLRTEERRRYIVRTTFLYGNPDTGATFPKFDLYLDTTEWTTVTIFDAARVYVKEMIIRAPSESVDVCLCCATTGAPFISTLELRPLNLSMYATNFED

SEQ ID NO: 633 - protein, 296 aa, Eucalyptus grandis
MAPPSSLLLPLFLSLFLQSCRLSTSAPPSLPKRASLSVENPDDLLVSPSGAFSAGFFPVGHNAYGFAVWFSHPPCSGAACTPVWMANRQAPVNGRRSTLSLLNSGSLVLTDAGAEVWSSGTSSPSAAELRLNDTGNLFLTDGSGGVLWQSFDSPTDTLLPQQPFTGKTFLISARSRYNYSTGFYKLYFDPNNVLRLLFDGPSISSVYWPYPWFSNDQLGRFPYNSSRIAVLDLLGRFQSSDNYSFSTSDYGVTAMQRRMTLDFDGNLRVYGRELGSTVWARDVGSAQHPCFIHGVC

SEQ ID NO: 634 - protein, 111 aa, Eucalyptus grandis
MGNLSFQLILSCSYLFCLICIASGFVPLDNYLIDCGSPRNASVGNRTFLADNFYSDILSTAQNILANTNSSSLSSSYDSTLYLTARIFDQASRYTFPIKENGRHLIRLYFF

SEQ ID NO: 635 - protein, 67 aa, Eucalyptus grandis
MEGKHLVFLTILLLESICSNVSAIPNEDKQALLDFLGNVSLSRPLNWNKDSSVCRSWTGVKCNNDQS

SEQ ID NO: 636 - protein, 72 aa, Eucalyptus grandis
MGNLSFQLILSCSYLFCLICIASGFVPLDNYLIDCGSPRNASVGNRTFLADNFYSDILSTAQNILANTNSSS

SEQ ID NO: 637 - protein, 163 aa, Eucalyptus grandis
NFRFTISLALFLFLNFLSNSSRTTEAAPTYLEHDCPNTTLVSPNSTYRSTLNALLSSLSSAAAGDADGFANATAGKDAPDRAYGLFLCRGDVGTATCSECVATGTKDILRWCPDRRSSVVWYDECMLRYSDQSIYSVMGDGTDIHDAGTTGTSPNQDWFMQLL

SEQ ID NO: 638 - protein, 109 aa, Eucalyptus grandis
CIQIGLLCTQGDPHLRPTMGRVVVLLSKKPGNLDEPITRPGLPGTRYRRSRRPHGLSGSTGTTSGTSSTAMHSFGSGINTRSETQSTATTTTMSSLPSPSDPHGKRPMQ

SEQ ID NO: 639 - protein, 139 aa, Eucalyptus grandis
MPRPTPSPPHIHIFFLSYIPCLVFLCLLSNAAESQIQDQEQQVLLKLRQSWRDPSSLDHWVASNSSSHCTWPEITCQEGSISELNLVNLNINYSIPPINRQPKKPNQARHLLQQYSWRVSHCSLQLFQARVPRPVPELL

SEQ ID NO: 640 - protein, 185 aa, Eucalyptus grandis
MFSLFFLLLLPLLSASAPVPHPYGNVSYHIDCGGNSPVVDSFNTTWLPDRYFTGGAAAVVSEPLRFRQPQEKTLRYFPLSSGKKNCYVLPGLPSGRYYLRTFTVYDNYDGKSHPPSFDASVEGTLVFSWRSPWPSPDLAGGSGAYSDLFAFVRDGEADVCFYSMATDPPVIGSLSLVQVDPLSYD

SEQ ID NO: 641 - protein, 120 aa, Eucalyptus grandis
MAATAAKPPCKPASYFCFSSSFCLLLFVSASLAQSDLDVLLQLRAALAAPNSTALHDWVGPSSSSSSSSSPPPFPHCSFTGVTCDAGSRVVSLNLTDVRLFGRVPAKSASSATSSTSRSP

SEQ ID NO: 642 - protein, 919 aa, Eucalyptus grandis
PTSFSNCTSLHTLSLANNMFTGEIPHSFGRLASLQKLDLSHNHLTGWIPDELGTACNSLIELTLSFNNISGPIPLSFSSCSWLQSIDLSTNNISGPFPDSILRNLGSLESLLLSNNTISGLFPASLSYCKKLRIIDFSSNQFSGIIPPDLCLGAALLEELRAPDNLITGNIPPQLSQCSQLKKIDFSLNYLVGSIPAEIGMLENLEQLIAWFNGLEGEIPPELGKCRNLKNLILNNNHLKGEIPTELFNCSNLEWISLTSNELTGEVPREVMLLSRLAVLQLGNNSLSGQIPWELGNCSSLMWLDLSSNKLTGEIPPRLGRQLGAKGPAGIPSGNTLVFVRNVGNTCKGVGGLLEFAGIRPERLLQVPSLRTCNFARMYSGPILSKFTTYQTVEYLDLSDNQLRGKIPEEFGDMVALQVLELSYNQLSGEIPSSLGRLKDLGVFEASHNRLQGQIPDSFSNLSFLVQIDLSYNDLTGQIPQRGQLSTLPASQYEHNPGLCGVPLPECRNNEPETNPDVAMGTKGRAKPGTASWANSIVLGILLSIASICILTVWGIAMRSRRKEAEEMKMLKSLQAAHATTTWKIDKEKEPLSINVATFQRQLRKLKFSQLIEATNGFSAESLIGCGGFGEVFKATLKDGSNVAIKKLIRLSYQGDREFMAEMETLGKINHKNLVPLLGYCKVGEERLLVYEFMEYGSLEEMLHGRVKTQDRRILTWEERKKIARGAAKGLCFLHHNCIPHIIHRDMKSSNVLLDHDMEARVSDFGMARLISALDTHLSVSTLAGTPGYVPPEYYQSFRCTAKGDVYSLGVVLLELLTGKRPTDKEDFGDTNLVGWVKMKVREGKQMEVIDPAMLSTTKVQEEAEAEAEAEVVKEMVRYMEITLQCVDDFPSRRPTMLQVVAMLRELVPGSTTVSSNST

SEQ ID NO: 643 - protein, 180 aa, Eucalyptus grandis
DFAREWREILMGLYRIGRTMSELWIPVRGLVWSARTDKYRQGTGRNLKDLGLEGMLTPELGKLTHVKSIILRNNSFWGNIPGEIAKLKELEVLDLGYNNFSGSFPSELGNNLSLTTLLLDNNEFMGFISPEIDELKTISESQMHERQESSLAMGADSNSMTNIRNGVHPQTATYRRQILA

SEQ ID NO: 644 - protein, 141 aa, Eucalyptus grandis
AYIHEHSPRKYVHGNLKSTKILLDDEFQPHISGFGLNRLISGTPGFTASSSKKHGSNNQTVLSSAMELKMPAPSVANLAPETRVSSTKVTQKSDVYSFGIVLMEILTGQVPDAGPDNDGKGLENLVRKVFREERPLSDIID

SEQ ID NO: 645 - protein, 155 aa, Eucalyptus grandis
IIGKKMPLLRLVSLYGNNLSGDVPNSLCMLDELSFLDVSKNQLLRRLPQCWRNSQANLEWISSGDNKLNGQIPYSLCHLKQLGVLGLRKNGLNGVFPKCLLKLDLVDLDLSDNQFTGRIPPFGQHAQLFKTIDLQRNHFIGNIPLQLCHLVNLQY

SEQ ID NO: 646 - protein, 171 aa, Eucalyptus grandis
IAGAAIAVSVFGVTVTGSVSVKMKLRLKKFNFEQNGGEILKQRKVKIFTEVELAKATNDYNDSNKLSDDHSSSVYKGTIARDTMVVVKKPQDEHKSIIRRHFKGEHFEDEHFEDELEFLMRRSHKNMVKLKGICLETEIPLLVYEYIPNDTLFELIQQNELTWEQRFKIAA

SEQ ID NO: 647 - protein, 240 aa, Eucalyptus grandis
MKIGHWLLTVAVAWWFQQGSAAVRRDCTRQCGGVPVPYPFGLEPNCSRSTDFLLDCTNIGGSGFRLMLGDLTILKISVGDSTMVVSLPEAYECYDQNRSLANRNVSINLPPNPRYRFSETQNKLIVVGCNALADMANKEGTVRKGCASYCSSNVDLAKETTCSGQVCCQASIPAGLTTLNISLSSIGQNVSNSERGHCARAFMVDNRPFNILNLTLPTFQDVGNNSSLVLDWMVQSDEIC

SEQ ID NO: 648 - protein, 322 aa, Eucalyptus grandis
SLLSLKSSLRDPHSTFHDWDPTPTFSNPTLQNPAWCSWSGVKCNPQTSQITSLNLSRRNLSGAIPAEIRYLTSLLHLNLSGNAFDGILQPAIFELTELKTLDINHNNFNSTFPMGISKLKLLRAFNAYSNSFTGPLPQELVSLQYLEYLNLGGSYFEGEIPSDYGNFPRLKSLFLHGNVLEGPIPPELGSLAQLERLEIGYNQYYGGIPSELALLSNLRYLDISAANLSGSLPQELGNVTKLETLFLFGNRLTGQISRSFSSLEALQALDLSDNQLSRDDTRRAGVVETARHLGFDEKQPQRGSTTNTWRASTAGDAPALEQ

SEQ ID NO: 649 - protein, 262 aa, Eucalyptus grandis
CSSFYWWLWWLRQGGAPTVAGHCAHRCGRVPIPYPFGLEPQCARSKEFLLHCNTSEGSGDQLLLGNIPIRKISVGDSTMVVSLPELHECYNKTGQLVSRSDNLSIDLSSYPQYKFSATRNALTVLGCDTYALTKVLAADKDDFSRGGCISYCSKYVDLAKETTCSGIGCCQASIPKGLNTLQVRISSFNDHVNVSSFSPCGVAFVGDKESFNISSKRLPTFDDLDKKSDLVLDWMIGWNVNCAQATSNQSSYACGNNTDCDN

SEQ ID NO: 650 - protein, 159 aa, Eucalyptus grandis
MKVVQQLLLVAVAWWLRQGGAPTVAGNCAHRCGRVPIPYPFGLEPQCARSKEFLLYCNTTDGSGGQLLLGNIPIRKISVGDSTMLVSLPELHECYNKTGQLVSSTDNLYINLTSYPPYRVSATRNNLTVLGCDTYVLMTDRYGLFRSGCISYCSEYVDL

SEQ ID NO: 651 - protein, 97 aa, Eucalyptus grandis
MKIVRHLLLVAVAWWLQQGGASTVAGHCTRRCGSVAIPYPFGLEPQCASTEHTKEFLLYCNKTEGIGGRLLLGNYTIRKISVSDSTMVISLPELYDC

SEQ ID NO: 652 - protein, 254 aa, Eucalyptus grandis
MRSSVPSLFLLFLCFAHGTADPTDNGPCPPQRCRRHHGPLVQFPFLLERKGQHDDCGYSRDFHLSCDQSGNTLLSLPGTPRPLVVTDIDYEGSSISVRDRDGCIPLPLANLNHSIFSYEKSQPSQYSSYQPPYNYTLFQCPRDGRSEGRMTRLDCQSTSAYDVFAVESYSYVGDLPLVSCMRNGSIDLLPKMISMMGEVNLVWEKPDCRLCTKNGSLCRGNENGIRCINPPGGYKERRKLEIAGGVVGFFLFLG

SEQ ID NO: 653 - protein, 175 aa, Pinus radiata
MIALRLLRDSCIRKPDEFLETIKELGSIRYNHLVAILAFYSGSMGEKLLVYEYIPRGNLAELLHNANRPAPGWAKLHRIALGAARGLAYLHTCLETPIIHGNLKSKNILIDDNYEAHLSDFGLHLLMNPSTKLAMLEASASQGYKAPELLKMNKANTKTDIYSFGIILLEILTGR

SEQ ID NO: 654 - protein, 98 aa, Pinus radiata
SLQVLDVGSNVLISGSIPVELGLLHKLRVLDLSVNYLEGGIPPQMGHLKALRVLDVSYNVLNGSIPADLGLLQKLQHLLLGGNKFSGSVPHQLGQTNS

SEQ ID NO: 655 - protein, 135 aa, Pinus radiata
EIQKATNNFDENLILGVGGFGKVYKGELEDGTKVAVKRGNPRSEQGLTEFQTEIEMLSKLRHRHLVSLIGYCEERCEMILVYEYHGQWASEELICMGQIFHLCPGNRGLRNMYRGGKRPPLPSYWGSTGVFHRDV

SEQ ID NO: 656 - protein, 183 aa, Pinus radiata
ATQNFEDQNKIGEGGFGPVYKGILADGREIAVKKLSVKSKQGKTEFMNEVKIVAKIQHRNLVKLLGCCAAGMEKLLVYEYMPNNSLDKILFDPERCRILDWQKRYNIILGVARGLLYLHEDSQPRIIHRDIKAGNILLAQTLNPKISDFGMARLIRENNTQLKTRIAGTYGYMAPEYAMMGTY

SEQ ID NO: 657 - protein, 106 aa, Pinus radiata
GDKHLVTWFRRMLMSREGFRKAIDPVLDVTDDTFQNICTVAELAGHCTSREPFQRPDMGHAVNVLSPLVEQWKPAKTDSEDCYGIDLDVPLSQALKRWQAVEGGVP

SEQ ID NO: 658 - protein, 203 aa, Pinus radiata
NGETVAIKRLWNNGNAEGSTSCNDNGFKAEVETLGNIRHKNIVKLWCCCVNDDSNLLVYEYMPNGSLGDLLHGPKAGDLNWPTRYKIAVGAAQGLAYLHHDCVPPIIHRDVKSNNILLDADFGARVADFGLAKVLQSYEKGIDSRPQMPEPKGKKPQKKQKTPKGKKKRKTKSLEGGLQNQGTANNPEIKNLKKRKNVVMWVR

SEQ ID NO: 659 - protein, 183 aa, Pinus radiata
NPRIIHRDVKTSNILLDDNFEAHLSDFGIAKCIPSAKTHTSTYVMGTIGYIDPEYARPSRLNEKSDVYSYGIVLLELLTGRKAVDNDSNLLQLILSKADNNTVMETVDQEVGVTCTDLGVVRKIFQLALLCTKRQPSDRPTMHEVTRVLQSLVPASKQAPGIRVNQPAPSNNYRRYLDEYVEG

SEQ ID NO: 660 - protein, 381 aa, Pinus radiata
LQSMDLSNNLLEGEIPEEFSQLKELALVNLFRNRLHGSIPSFIGDLPNLEVLHIWGNNLTGGIPQQLGRNSKLLEVDLSSNKLTGFIPPDLCIGGKLQILILLENFFFGPIPESLGNCESLTRVRMGNNYLNGSIPKGLLYLPKLGMFEVHDNYLSGSIPPKSTVTSSLGHLSLSNNRLTGPLPDSIGKFSNLQILLLDGNQFTGSIPPEIGHLKELSKMDFSGNRFSGAIPPEISYCKHLAFIDLSRNELSGPISPQITKMRILNYLNISRNHLVGSIPREIAGMLSLTSVDFSYNNLSGLVPGTGQFSYFNATSFAGNPELCGPYLGPCTAVSSSKEAHIKGPFSSTFKLLLVVGLLICSMAFAIAAVIKARALKKANT

SEQ ID NO: 661 - protein, 105 aa, Pinus radiata
EYEPRITDFGLARLMNPVDTHLSTFINGDFGDLGYVAPEYMRTLVATLKGDVYSFGVVLLELITGQKPINVENVENSFKGNLVDWITQLSNDARIEEAIDKSLIG

SEQ ID NO: 662 - protein, 154 aa, Pinus radiata
LQYQRISYQELHTATNGFAEANLLGTGSFGSVYKGVLNDGTVVAVKVLQLQNDQAEKSFKAECSVLQKVRHRNLVRIITSCSNLQFKGLVFKFMSNGSLEKHLYPNKDDNNSEDVCELGLKMRLDIAIDVAQAMKYLHHDSFVQVMHCDIKPNN

SEQ ID NO: 663 - protein, 97 aa, Pinus radiata
TLGNLTELKVLSLRQNRLSGSLPPDFVNLKLLGNLYLQKNMFSGPLPSSLSSLVGLNVLDLSFNHFNGTIPVFLNNLKSLTSLDLQNNSLTGNISNL

SEQ ID NO: 664 - protein, 167 aa, Pinus radiata
HIPVEFANLTKLTWLYLSSNDLTDIPKCIAKLTKLTSLSFSFNRLANNIPEAIFNLTKLEMLDLSSNMLIGDIPITLTNLKNLKILDLSNNNWKGTIPRAIGKLHLLESLMLQSNKLTGHIPYSIGQLKALYTLNLYNNSISSSIPESIMVDSLYTLDLSETLGGPI

SEQ ID NO: 665 - protein, 179 aa, Pinus radiata
PPSPSPLSHDMVSHSLRKGAMAAIVSVAAVTVAAMVFFLLCLYRRRKAQAMKKWVVPKPPFMWKTDRSVTESGPFSFETDSGTWVADIKDSTSASVIIFEKPLLDLTFSDLLALTSHFSKESQLAEGQNGPVYRAILPGDIHVAIKVLEGAKDLNAEEAVSKLEALGRLKHPNILPLLG

SEQ ID NO: 666 - protein, 227 aa, Pinus radiata
IAGLSKLTRLDLSQNMLSGPLTLSLGKLGSLQVLSISGNMVSGSVPGSLNNLKNLMRLDLSHNRLSGVIPPLGGMINLDNLDLSFNGLVGGIPSQLPRSLSQLTLKSNLLRGNLPPSLSSLSELGVLDASINRLSGAIDGSLFAHPSLQQLNLSNNSLSAISVLKGTGKNSQIVAVDIGFNRITGSLPPNFSTLDSLASLTLRYNQFQGSIPVEYGVKAMNSSRPLA

SEQ ID NO: 667 - protein, 66 aa, Pinus radiata
QIAMACVGRMPDQRPKITEVVRMIEEVKQFDSRPSSEDKSKDSNGHTPSHQRTPPSGVHTPSATTP

SEQ ID NO: 668 - protein, 194 aa, Pinus radiata
MEVRMITIMILCAALLCEGSGEVDVLMEMKAALDPKGEILYSWVKGGDPCSGTFDGVACNEQGKVANVSLQGKGLSGSIPSTIGKLKCLTGLYLHYNSLGGEIPRELSNLTELLDLYLNVNGLSGPIPKELGAMSSLQALQLCCNKLTGPIPMELGSLKKLNVLALQNNHLNGAIPASLGVLTSLTRLDLSFNS

SEQ ID NO: 669 - protein, 137 aa, Pinus radiata
LLDQHLNPLLSDCGLHKLLADDIVYSILKSSAGMGYLAPEYTTVGRLTEKSDVYAFGIILLQLLTGETRINSSSIRSLVQSGRPDEFIDITLGKEYSKEEASNLARIALDCTNEVAAQRPPISVVLQKLAWIDDKEQ

SEQ ID NO: 670 - protein, 161 aa, Pinus radiata
VEPPGSMVISIQVLREVTDNFSEGNILGRGGFGVVYKGELHDGTKIAVKRMEAAKVSSKGLSEFQAEIAVLTKVRHRHLVGLLGYCIDGGEKMLVYEYMPQGPLSLHLFEWAAAGLRPLEWKQRLSIALDVARGVEYLHSLAQTSFIHRDLKPLISFWATT

SEQ ID NO: 671 - protein, 143 aa, Pinus radiata
IERGKYIVREVKSALEAGGIGTLVSELVDPLLLGSDSHGTLLPGLESFVNLALKCAEESAADRPSMSDVVKELESIATNCKDDDGPYNNSSASSLASDSGAINIKGFYYTQSSNYTSDDGILKKGGSFEYSGGYSVRHTVEPK

SEQ ID NO: 672 - protein, 162 aa, Pinus radiata
EFGLVVAVKRLKDVVIGQKEFVQQIEQVGKMQHENLVPLRAYYFSKDEKLLVYDYMTMGSLSSLLHGNRGAGRTPLDWETRSRIALGAARGIEYLHSRGREISHGNIKSSNILLTRDYNAGVSDFGLAQLVSSTPSANRIVGYRAPEVTDARKISQKADVSS

SEQ ID NO: 673 - protein, 77 aa, Pinus radiata
ENEQGQVLRVVLIAFLCVQGLSSQRPSMSMVLNMLTGDSDILVTPSAPALIDSEHISVSSVARAQTLHVSTPPSTSH

SEQ ID NO: 674 - protein, 295 aa, Pinus radiata
MTSTATDRSRALSVASRKSNVYGNTFNANSKPGTMTFTMSGLSKATGNFSPSNKIGQGGFGTVYKGKLKDGTLVAIKRAKKNIYDKHLSVEFQSEIRTLSSVEHLNLVRFLGYLEDEQERILVVEYVPNGTLREHLDCVHGIVLDLATRLDIAIDVAHAVTYLHMYTDRPIIHRDIKSSNILLTENFRAKVADFGFSRLAPEDIGATHISTQVKGTAGYLDPEYLKTYQLTTKSDVYSFGVLLVEMITGRRPIEHRRELRERITVRWALKKFLEGDAILALDPPGCRNSISSLSI

SEQ ID NO: 675 - protein, 136 aa, Pinus radiata
ENVLGRGGFGKVYKGVLRSNGQEIAVKCITKPFREGMKGFVAEISSMGRLQHRNLVQLRGWCRRYKQLFIVYDYMPNGSLDKRIFGNPATVLPWPQRYEILKGVAAGLLYLHEQWEKRVLHRDIKSSNVLLDSELN

SEQ ID NO: 676 - protein, 161 aa, Pinus radiata
DGSNVAIKKLIRLSCQGDREFMAEMETLGKIKHRNLVPLLGYCKVGEERLLVYEYMQFGSLEDMLHGEKGGFKTRLTWEVRKQIAKGAARGLAFLHHNCIPHIIHRDMKSSNVLLDRNMEARVSDFGMARLISALDTHLSVSTLAGTPGYVPPEYYQSFRC

SEQ ID NO: 677 - protein, 154 aa, Pinus radiata
TLHQNKMIRELEKLAKLCHDNVMRPVGFVIYDDVALLLHYHLPNGTLAQLLHREDGTSEFEPDWPRRLSIALGVAEGLAFLHHCHTPIIHLDIASANVFLDANFNPLIGEVEISKLLDPSKGTTSITAVAGSFGYIPPEYAYTMQVTAAGNVYS

SEQ ID NO: 678 - protein, 161 aa, Pinus radiata
ASLGGAVALVCVALLVFCVLRNRGRSHKQTSISEGPKPPSPAIENTKKNLISGISDCIEKSFLYSIEDLQKATQNFSPSSNIGGSVYKGTIDGKDYAIKIMKGDISQELRLLQKVNHTNLVKLEGFCVSSEGQSYLVYEYVENGSLSIWLHDPESVQDMNA

SEQ ID NO: 679 - protein, 120 aa, Pinus radiata
NLSWNLLDGSLPMEISKIAMAQAIDISSNHLTGLIPPTLGSCSELQTLNLSRNAFQGSIPDSLGTLLSLVNLDLSFNSLSSPIPPTLQKLKMLQCLNLSFNNLTGEIPKEGFLQIKQFIM

SEQ ID NO: 680 - protein, 122 aa, Pinus radiata
GVGSKSDVYSLGIVLLELVSGRRCVDLSAPAEDCYLPAATIRRFQEGKLMEIVDPRLVDEVPEEDEPRKVVIVALWCIQEDPARRPAASAVSRMLEGHIQIHEPPMASLQSALSRQRQIWIT

SEQ ID NO: 681 - protein, 163 aa, Pinus radiata
LNGNANLCGPKIFQLYPCPTPKGQGHSTIVKRVLLTVGGATSFILCCFFLRFLWRGNIHIQNIHVSRSIFQKLEHPRISYQELHIATNGFDKANLLGAGSFGSVYKGILNDGTLVAVKVFQLQNDQSEKSFKAECSVFEKVQHRNLAKIITSCSNLHFKALVF

SEQ ID NO: 682 - protein, 301 aa, Pinus radiata
IVKQVLLSISGAIAFILCCLLLRFLWRGNMHIQSIDVSRAIFQKLNYPRISYQELHMATNGFSQANLLGTSSFGSIYKGTLKDGTFVAVKVYQLQNDQAEKSFKAECSVLQKVRHRNLVKIISSCSNLHFKGLLFEFISKGSLEKHLYPDRDDNNGEDSCELGLKARLDIAIDVSYAMQYLHHDCFVQVVHCDLKPSNVLLDGDMLGHVTDFGISRLIGESSTSSLTSTLCLRGSVGYIAPEYGLGGIVSTQGDVYSYGILLLEMLTRKRPTSDIFDGNLNLHNWVKSTFQNRLKEVIDSV

SEQ ID NO: 683 - protein, 121 aa, Pinus radiata
DRNLESHVADFGLAKLLEDQESHITTIVAGTFGYLAPEYMHSGRATEKADVYSFGVLLLELLSGKRPTDSAFIEKGLNVVGWLNLLVKENRPRDIIDPQCEGVQMESFEALLYVAIQCVSP

SEQ ID NO: 684 - protein, 137 aa, Pinus radiata
DEMIAATKGFSTKIGKGGFGLVFSGELPEGKSIAVKVRSPSSDQGVDEFLNEVDLLSKINHRNLVSLLGYCNQSSQVRLIYEYMSGGSLMDHLYGVNAGNSELNWEIRLKIALDAAYGLHYLHTGSVPKIIHRDIKT

SEQ ID NO: 685 - protein, 109 aa, Pinus radiata
SPYLGNLSLLRSLSFSHNNLTGRIPPNFGKLKVLGTLDLSFNKLEGSIPVELGLLQKLQKLALHFNKLENAIPPSLGNCSSLMILRLGYSRLSGHIPPELGNLRELRHL

SEQ ID NO: 686 - protein, 121 aa, Pinus radiata
LATLSFILFLNPPFVFSTPIAHFPHHPPRLTNASDQHALLAFKSAITYDPSHSLATSWLPNVSFCEWTGIICSRRRQRVVSLNVSHMGLQGTISPFLANLSFLRTLDLRNNSFQGHIPYQL

SEQ ID NO: 687 - protein, 162 aa, Pinus radiata
RVVHRDIKPSNIMLDGEFNARLGDFGLARLIEHDETNPAVTTMLAGTPGYVAPECGYTGKATAESDVFSFGIVVLEVASGRRIVERGPPLSEGNLVDWIWGLYGQERIMEAADPRLDGDFDEEQMKRVLILGLACSHPDPQLRPSIRHALQVLINPNEQMKP

SEQ ID NO: 688 - protein, 140 aa, Pinus radiata
VFTFLILGMLIRGCRLHRRDSNKVNNRTFWEMKSFHKLNFDEHEVLESMDEEHIIGHGGSGTVYRIQLSNGESVAVKKLWTCKNGHHGGQGLINRELKAEVETLGTIRHRNIVKLYCYFSNGDSNMLVYEYMPNGNLWES

SEQ ID NO: 689 - protein, 196 aa, Pinus radiata
SMPAELGNLSSLDSLFLFLNVLSGPIPPQLGNLRNLKSLDLSFNDLTGQIPEEFKNLVSLTLLNLFHNRLHGGIPDSIGDLPDLEVLNLWSNNVTGSIPRRLGRNGKLLTLDVSSDKLTGLIPPDLCMGGKLQSLILLGNLFFGPIPATLGSCKSLTRLRLGDNYLNGSIPVGLLNLPQLSLIELQDNYLTGPLMP

SEQ ID NO: 690 - protein, 175 aa, Pinus radiata
VYKAMLSNGEFVAIKRLWSSGKSDAPNDHGFKAEVDTLGKIRHKNIVKLWCCCSNSDSNLLVYEYMPNGSLGDLLHGPKSSVLDWPIRYKIALEAAQGLAYLHHDCEPSIVHRDVKSNNILLDDDYRAYVADFGVAKILQSGGNGTDTMTAIAGSYGYIAPEYAYTLRVNEKSDI

SEQ ID NO: 691 - protein, 261 aa, Pinus radiata
KYLTSGRIAGIAVAGLLTLIAAVLIIMFFVTRKQDRNSGVEKKYKGRDKYKNEEKIFYKDVEKEIKAKSSLAEPPTPVTKPVQNENQEEEANTGLEEVSIKLPPIEKYKAPVNVPLEKPAWKPPVKAPKEPIASTAYTVAALQQFTNSFGHDNLIGEGNLGRVYRAELPDGKLLAVKKLDTSASMSQKDDDFLEVVSNISKLRHSNIVELVGYCVEHRQHLLVYEYMSNGTLHDILHSGDELNKKFSWNVRVKIALGAARA

SEQ ID NO: 692 - protein, 285 aa, Pinus radiata
TGPIPVHICQNSSSLQYVDFSLNRFNGTLKEGLGQCRKLQALNAGFNSLAGPIPNDLYGMSSLRQLRLPFNQFTGTLRAEIGNLSNLSVLSLSANRLTGLIPLELGKLENLEGLILHSNRFTGMVPSRLSQCKKLKILNLKNNSLTGVIELNFTSLPELIYLDLASNNLSGSIPPSLWTCKNIQSVSLARNKLSGEIPPGMASLQVLSFFSISNNSFINITSALTALQDCHNLTTLVLSKNFNGGMIPTDIHGFPMLRTFSLGDCALSGQVPVWLLKCPNLQVLD

SEQ ID NO: 693 - protein, 150 aa, Pinus radiata
EQCRSCLSIALLNLYNITMQEGAEALLGNCRVRFETRPFSPLFASNGSTSQISPKKSSKTLAILCGVIGGGLLAFSVCLYLMRKRMRSAILLRSVVLTQTEEMGDGGYGSLFNSQIVFRLDTLIEATGKFQEANKLGEGGFGAVYKGVTS

SEQ ID NO: 694 - protein, 199 aa, Pinus radiata
LLNVFTSRYALIADTTKCHSLKWRERYEIIVGTARGLAYLHEESDIRIIHRDIKASNILLDKNYKPKIADFGLAKLFGEDKSHVSTRIAGTFGYMAPEYALCGQLTEKADVFSFGVLVLEIISGRKNQSLPQHMVFLPEETWRLYKEERALEVMDPTLEGRYSCEEAMRVIKIGLLCTQGAATLRPSMSLVVSMLTSER

SEQ ID NO: 695 - protein, 388 aa, Pinus radiata
WNFANSTKGFICNFLGITCWHNDDNKVLSISLPDMGLQGEFPSGVQSCKSMTSLSLSQNSLTGTIPRELCQWLPFLVSIDLSQNKFTGPIPAELHNCTYLNILHLNGNQLTGEIPWQLTRLDRLKDLNVANNKLTGIIPSFTHNISVSSFQGNPGLCGPPLKNACGTSNSSIGVPIGAAVAGVLIVSLLGFAFWWWCIRISPKKLAEMKDENKWAKRIRAPKSIQVSMFEKPINKIKLSDLMAATNDFSPENIIGSGRTGTVYRATLADGSVMAIKRLRDTAQSEKQFKAEMNTLARLRHRNLVPLLGYCIAGQEKLLVYKHMANGSLWDGLHSKENPENNLDWTARLKIGIGGARGMAWLHHSCNPRVIHRNISSNSILLDEEYEPR

SEQ ID NO: 696 - protein, 79 aa, Pinus radiata
DAADPRLNEFDKDEMICMLLVGMACSHPNPQERPTMRQVLQILTKDAPPPLMPLFKPAFVWPAPGMTDIQSSSSDFSTQ

SEQ ID NO: 697 - protein, 200 aa, Pinus radiata
KNLSQLNINGNKFTGSLPTKIGELQNLGEIIASNNLLSGALPPSLGKLQQLGKLDLSNNQLSGELPAEIGSCKQLGEINLSKNQISGSIPANLGSLSVLNYLDLSDNLLTGSIPSELGNLKLNTCNVSNNRLSGTVPLAFESPVYEKGFLGNPELCSQEAFNGMESCSKERSERAKRRTWWWLLRCLFALSLIIFILGLA

SEQ ID NO: 698 - protein, 241 aa, Pinus radiata
IRLADLMAATNDFSKDNIIGSGRTGTMYKATLQDGSLLAIKRLQSSAQTEKQFKSEMNILGHLHHRNLVPLLGYCVAKNEKLLVYRHMANGSLYEQLHDHEIEDGSYLDWTRRLKIGIGAARGLAWLHHSCNPRIIHRNVSSNCILLDENHEAKITDFGLARLMNPVDTHLSTFINGDFGDLGYVAPEYMSTLVATLKGDIYSFGVVLLELVTRQKPIEVTDVQESFKGNLVEWISIFKKW

SEQ ID NO: 699 - protein, 102 aa, Pinus radiata
KQINAVIGENSFCLPNPGPCDKKVDVLLSFAQGVGYPYVLASDWKGNDPCGGWQHVTCDNGNITILDLVGLDLNGTISPTLASLNSLRALLLSNNNLTGGIP

SEQ ID NO: 700 - protein, 75 aa, Pinus radiata
GLAYLHHGCSPAIVHRDVKSTNILLDKSYEAKIADFGIAKFLQAHSGRDSTTAFAGTHGYIAPGSTFLPYFAPLL

SEQ ID NO: 701 - protein, 147 aa, Pinus radiata
YFNGSIPEQYGMFKNLKYLHLAGNSLTGKIPPELGRLHGLRHLEIGYNFYEGGIPWQLSNMTELEYLDIAQANLSGALPWELGMLRKLNALFLFKNNLSGTLPPQLSNLRSVLSLDLSNNTISGSIPLGFSRLKNLKLLSLMYNNLS

SEQ ID NO: 702 - protein, 238 aa, Pinus radiata
WVAVGLTGFIIVVVLVVGGVFWRRGHENRKSVRVLDRALTDSTGGPRKFRLREVRRATRNFDRKSLLGQGGFGAVYRGVLSNKTPVAVKRVSENSNQGEQEFMAEVMIISRLRHKNLVRLLGWCHEDNELLLIYDLMPNGSLDKLIFEEDAKHEVLDWHHRCKIVCGVASAMLYLHEECEQQVIHRDLKASNIMLDSDYNARLGDFGLARLIELNKNSYTTTAIAGTPGYIAPEYFHT

SEQ ID NO: 703 - protein, 126 aa, Pinus radiata
QTSDIDALNSFRAKADPGHVLDGKWVNGTDVCTWEGVKECIDGRVTKLSLQYSRLNGTFADGSLSQLSELRVLSLKGNGLTGTVPDLCGLTNLKILFLDHNRFTGPFPESLTTLRRLVVVVLSFNQ

SEQ ID NO: 704 - protein, 123 aa, Pinus radiata
EGIEQGDKQFRMEVATISSTHHLNLVRLIGFCSEGRHRLLVYEFMKNTSLDTFLFESSEQTRKLDWQTRLNIALGTARGIAYLHEECRDCIIHCDIKPENILLDDNLNAKVSDFGLAKLINTR

SEQ ID NO: 705 - protein, 158 aa, Pinus radiata
HEDCRNRILHCDIKPHNVLLDANFLPKVADFGLAKISDREESHVSVANRGTLGYAAPEMWSRLYGVVTDKSDVYSYGILLMEMVGRRKNIDYKYLESNSSKFFYAEWAFKQVEKGEFENLRKEDMSEEDQVIAKRLSLVGLWCIQFKASRRPSMSKVV

SEQ ID NO: 706 - protein, 178 aa, Pinus radiata
FPKQSSQAVIEFHTEIEAISGVLHRNILRLLGYCTHRQKRFLVYEFMPNRSLDIHLFGDRGIFLPWETRFQIITGISRGLAYLHDHSRVPVVHRDIKAANILLDDNLHSKIADFGLAKLFPDDRTHITTDVGGTIGYMAPEYVVHGHLTQKADVYSYGVLVLEILSGRRCMDPRLPSP

SEQ ID NO: 707 - protein, 230 aa, Pinus radiata
KILHLGIWRKMGRRRNMEEEVEEANRRIVEAESAAIEAHVKVEEYEAICEQLTTLIKEKEDAIQQLQNDARNAIKEKEAAIKERDEAREKLKKGAPPGRRFTRYTIQELKAATDNFSEDAVIGEGYYGKVYRGQFHVTPVAIKVLKLNWFQGSSRFHREMDRLSSIKHPRLVMLMGACTDGGFIVYEYMPRGSLEDRLLCQGGTPPIPWFDRMRIAAEVCEGLLFMHSLQ

SEQ ID NO: 708 - protein, 120 aa, Pinus radiata
RHTGRRVTIRTLVVTDLQIGSLATIPIRCKCPSQAQLNNGIKMLITYVVHPEDTPSNISQKFGADLQNLISFNGINSTLIPYSTLLVPVSKKPVLTQPPPSAPSPPPPPPTVVNNTTSSG

SEQ ID NO: 709 - protein, 179 aa, Pinus radiata
LLFAIFAIVFQLLRRKKPHESYFDVPAEEDPEVHLGQLKRFSLRELQVATDGFSQKNILGKGAFGKVYKGRLADGSLVAVKRLKDERSSAGELQFQTEVEMISMAVHRNLLRLRGFCMSPTERLLVYPYMSNGSVASCLRERQTDQEPLDWPKRRCIALGSARGLSYLHDHCDPKIIHR

SEQ ID NO: 710 - protein, 187 aa, Pinus radiata
NIAIGSAEGIAYLHHHATPHIIHGDIKASNVLLDTDFKAQVADFGFAKLIPEGATHVTPRVKGTLGYLAPEYAMWGKASEGCDVYSFGILLLELVSGKKPVDKMDSNTKYTIVDWALPLVLEGKYDQLADPKFHGKYNEEELKRVVHVAIMCAQNAPEKRPMMLEVVDFLTGESKEKLFKMININIE

SEQ ID NO: 711 - protein, 166 aa, Pinus radiata
GLQGTISPLLGNLSFLRMLDLSNNNFHGHIPYQFGNLFRLNTLYLFLNQLQGSIPPTLGRCRSLRIISMETNNLTGTIPSWLGNISSLEYINLGRNNLHGSIPSELGMLSQLRFIQLGVNNLTGQIPSSLANCTSLQVLAIVNNHFTGNIPAEFCTKNTQLTALFM

SEQ ID NO: 712 - protein, 122 aa, Pinus radiata
VLGNVRHRNIVRLLGCCSNNETTLLLYEHMPNGSLADLLHGNKEANVLADWMTRYKIAVGVAHGLMYLHHDCYPVVVHRDVKPSNILLDADMEARVADFGVAKLIQTDESMSVIAGSYGYIA

SEQ ID NO: 713 - protein, 161 aa, Pinus radiata
LWKNQTKYWETGVWNGQIFSKIPEMRQNSIYLFSFVNNGSYKYYTYSVKPELTYLSRFDVDESGEIRVYLMLANNEWSMFWALPRDQCDVYAVCGSYASCNGNNVQFCNCVPGFVPKDSREWDSQQWSSGCVRKTPLRCNHAGNGSTTDGFVELSGKSMPA

SEQ ID NO: 714 - protein, 173 aa, Pinus radiata
DNVLKRVIYLTLPYHKLRGSISPEMGKLSHLERLVLHDNNLYGTIPQDLGNCTQLRALYLQDNFLSGIIPSEFGKLSELKILDISSNSLSGVIPASLGKLTKLSIFNVSTNFLTGPIPAGGALNRFSGESFVGNLGLCGKQVNAICRSELEGPVSSSEPPVQGVSGAPNEVTL

SEQ ID NO: 715 - protein, 167 aa, Pinus radiata
TCVGGNVSTLDIADQHFVGTISPALSSLTSLTQIILSGNNLTGSIPSDLTQLPNLKKLDVTNNQLSGAIPKFASSVSVLTGGNPQIGKSPSPGSSPPGASSGSSGNSNGTSSGSNAGGGGSGSKAWIAGAVIGVLALVLVAGLCYCYASRKRQKSTRVQSPTTVAIN

SEQ ID NO: 716 - protein, 171 aa, Pinus radiata
MESVIIWRCCFMALFLLGLLQLNVISVSAALSKSDPFIYGLCNVNKYSNGSAYERNVNAVLEYLVRATAPRGGFATYSYGGVNGLLQCRPDISQQDCQKCSAKASQMAYQDCPNAIGARIQLEFCFIRYENYTFASVLDTVQAAAFENVKSNGDIEGFNQTLGNLMNTLSG

SEQ ID NO: 717 - protein, 304 aa, Pinus radiata
TSGSIPASWGNLSSLTDLYLNGTGLAGSIPESIGELSKLQDLDLSNNYLSGSLPKELSKLSDLQNLDVSFNNFRFVTVPTVISNLTGLLQLSLAGCGIEGIIPKWLSTMPNGLSTLDLSSNNITGTIPTWVGNMTGLYNLNLSNNALTSTLPEAMSNLRNLGVLDLHSNYLTGPITAAFSMQSPFPTGLLETVDLSRNKFTASIPSSVGNQNGMQQLVLSHNSLRGAIPSTLGSLAQLQTLELNENHLTGKIPNAFVNLTSLLQLNVSHNSLSGMIPVGGLLQKFPISSYSGNRRLCGDPLPAC

SEQ ID NO: 718 - protein, 133 aa, Pinus radiata
IPHHIGQCLALEVLDLAKNKLNGQIPPSIGNCKSMRTLLLQSNFLSGKMPPTLSRCTVLQRLKVFENKLSGNLDIRFPNSMEVFSAYSNNFSGNFPASLAECTHLQLLDLSKNKLTGQLPGYLATLQELRVLS

SEQ ID NO: 719 - protein, 289 aa, Pinus radiata
CCAEEGHRILVYEYLENNSISQALLGSDNTRMDMDWTMRAKICMGTARGLSFLHEELVPHIVHRDIKASNILLDRDLNPKIADFGLAKLFPDNVTHISTRVAGTIGYLAPEYAMRGQLTKKADIYSFGVLVLEVISGRSNTKSTLAVEEQFLLEWTWQLREENRLLEIVDPRLEEYPKEEVLRFIKVALLCTQAASNFRPSMSQVVAMLSKEININENLLSRPGFISDFKNLKVAAGTNRSPAGSHFHAFNSPQVAASHKGVSSSSATTCNSTSNVSSSCATITQLDGA

SEQ ID NO: 720 - protein, 222 aa, Pinus radiata
VVVIVCLILICILYKTYKNFAQAKSKTLSWKLTPFHRLEFDESDILKRLTENNVIGSGGAGKVYKVTLGDGTIVAVKQIWNNRKLQLGQDKEFQAEVDTLGKIRHANIVKLLCCISSSDSNLLVYEYMPNGCLYERLHNSEGETLDWPTRYNIAIGAAQGLSYLHHDCSPLIVHRDVKSYNILLDSEWKAHIADFGLAKTVEKLSQENVTLLIHFEGVSILC

SEQ ID NO: 721 - protein, 121 aa, Pinus radiata
FWPHRFSYRELNIATNGFRDENVLGEGGFGKVYKGVLRGSGQQIAVKSLMKQFKQGMKEFVAEISTMGRMQHRNLVPLRGWCRMQKQLFIVYDYMPNGSLDKLIFGKPMTVLPWPQRYAIF

SEQ ID NO: 722 - protein, 111 aa, Pinus radiata
ELKEATKGFSDKELLGFGGFGRVYKGVIPSTGLEVAVKRVSHESKQGVREFVAEIASIGRLRHRNLVQLQGWCRHKDELLLVYDYMPNGSLDKHLFESTKNLLNWAQRYRI

SEQ ID NO: 723 - protein, 258 aa, Pinus radiata
KIRISSIVGSPFSIGHDNPPQQSFVLDTSLDDNYSSVADCKALQYSKCHYNFNYTTDSKYERNLNSVMTRLIKDSSHTGFNTSENGQVYGLLQCRGDTTPDQCYTCSQQANTTLRQICGNAGGGLLWFDDENCFLRYENYSFFGQLETTDEWNLCNPKNVTPSPDVLIKAVNSLFNKLVDEATSGSTLYASGTTTDSLSRRIYGLVQRTRDMSIDNCTSCLQTTINGISTDCSGSQGARGLVGSCIVRYEMYSFFNST

SEQ ID NO: 724 - protein, 142 aa, Pinus radiata
DYWILIILCFATAASAQQSYEENAQLNCNSDNSPDITYGYTCNGQQQTCQAYASYRAQTGYQTLANISSLLNSNKSQMAHINKLSDTQLLDMDKAVIAPINCSCDGNYSQANTSYVVQPNDSYFIMANNTYQGLSTCQAMMQ

SEQ ID NO: 725 - protein, 182 aa, Pinus radiata
RTVTTVKAAKMDIFVLSGQSNMSGRGGVHGSHWDHFLPQECKAHPSILRLNSHLHWEQAHVPLHADIDKHKVCGVGPGMIFANTILKHYKDPKKARIGLVPCAIGGTAIKEWEKDSTLYKNMITRTKAALNHGGVLRAILWYQGESDTESEKNANSYKHNLERLIHDIRSDLKHPDLLFIQV

SEQ ID NO: 726 - protein, 135 aa, Pinus radiata
SDPRLCYFPAWAMLRALEGKYMDLVDKRLGDNSVDTEGVTRMTKVAFWCIQDNPNQRPWMSVALKMLEGEWEIPDAPMWLLQRGPEFLEGYGYEPMENRNGDDEEPDETSSVTGNSMGVRRSDESISSTQLSGPR

SEQ ID NO: 727 - protein, 166 aa, Pinus radiata
HIPSELCTKKTTQLMELYLSDNQLSGSIPSSLFNCTKLQLIELANNQLSGIVPMELGKLTHLRRLYLGRNHLISGNTTTCPILTALSNFSDLQLVDFSVNNFTGQLPFSIGHLSTKLEVLLLSDNELAGEIPPAIGNLSSLTFLSLANNSFTGSIPSSVSMLRKLE

SEQ ID NO: 728 - protein, 314 aa, Pinus radiata
MKSVLGSVLLIVTLAGTCMRLAVADPETPTVWSKCGESGNYTYRNGSAFQLNLNKLLDSLVNNVYATGFNTSSLEGQNSNGAVYGLVQCRGDLDSADCKQCASTARANLVRACHNTSGFIQLDGCFLRYDNHNFYNDLESRKNTPISVLCNTGNSSRPQQFTDAIKARLSNITLEAAQSPKLFAADAADEPSSLTGKIYSLAQCWRDLSRTSCGSCLTYALENIFKCQSGALGAQFGSQNCYLRYEVYEFFDNSVISQPPAETPPVSSGRKKSKTLAIILGAVAVGILGLIAAMVILRRKYFSNVKITEEKPVK

SEQ ID NO: 729 - protein, 161 aa, Pinus radiata
KFGSSAGILHRGSGRLLVYEYMPNGCLSDFLFHKKRNNDEQKVLDWKTRFAIAVGTARGIVYLHEKCRDCIIHCDIKPENILLDSNFCPKVADFGLAKLLGREYSKVLTTMRGTRGYLAPEWLSGLPITGKADVYSFGMTLLEIIGGRRNMDGDQESSEMF

SEQ ID NO: 730 - protein, 247 aa, Pinus radiata
SLSHNSYTGTVPIELRSLRNLYSLDLGSNRFSGPFPPSLGVLTHLQRLFLDRNYLTGRIPNEITGCRELAELKLDWNQFSGTIPEAISNLEWLNLLSLSGNLLSGPIPESLRKCIRLQNLDISYNKLTGSIPRSVASFRGLQINFNLSNNLLSGSIPSELGGMQMVQFVDLSNNNLSGAIPSSIAGCVGLQGLDLSGNTLLDQIPVALSRLQNLEQFLNLSNNHLQGEIPAELGELKLLRSLDLSSN

SEQ ID NO: 731 - protein, 116 aa, Pinus radiata
QNLPEQEVDIVQWAWSLQENDKLIKIVDKRLEMKYNPEQAFCLSVIGLLCTLSDPSSRPSMEEIVSYIKAEKSLPLLPSNRPTTYFPYPSTTELCNLNSCSSNVKIDLLGSSSSSK

SEQ ID NO: 732 - protein, 187 aa, Pinus radiata
SKLFWCLAALLCGICCCHSFSPAPSPVDFQEISGIQQCNQSDVQALISFKQTVSSSSPLNWEVNRSCCTWEGVTCGLLSLQQFSVTKLRLPGRRLRGTLSDSLGRLAHLREINVSFNLLTGEVPGRLFLLQHLEVLDLSFNNLSVIAPVAQGLNSIRTFNISSNSFRGNVPQLGSAVNLTSFNVSNN

SEQ ID NO: 733 - protein, 446 aa, Pinus radiata
MASLIGIVPLLLLLTLIPATESFNDTEALLQFRALTDSHGILAKNWSSADACTGKWQGITCKNGRVFFVSLSRHELRGPIDPLSALDQLRVLDLQGNRLNGSLDPLSNCYNLKLLYLASNDFSGLIPADLARLRRLVRLDASDNNLRGSIPPVIRNLTRLVTLRLQNNILSGPLPDLSFLGDLNVSNNEPSGQVPRQLLEKFPASAFAGNAGLCGRSPFPACTIPPPVAVVVPSNPSSDPGSSTPVDTRSKTRALSTGAVIAIVVGDAAVLILITLIFLVYYWKKYVREAEVAGKTASEKMDFSGGAQTPEMEKSKLVFFDRKKQFELEDLLRASAEMLGKGSFGTAYKAVLDDGCVVAVKRLKDVNPSGKKEFDQHMELIGKLRHPHIVRLRAYYYAKEEKLLVYDYLPNGSLYSLLHGNRGPGRTPLDWTTRISLVLGAAREYF

SEQ ID NO: 734 - protein, 91 aa, Pinus radiata
GRWGKFGDGVDIVQWVNKMTNSTKEGVSNILDERLSSVPLHDVIHVFCVAMACVEEHSVERPTMREVVQMLTDIPKIKPSENPLPASEGAE

SEQ ID NO: 735 - protein, 191 aa, Pinus radiata
SYGTVYKAKLVQGSTIVLRLLKEGTVSSRELFLPAVTDLGRLRHNNLVPLRAFYEGERGEKLLAYDYMPKGSLADLLHGSGRQHLNWARRQKIALGAARGLAHLHTGLETPIIHGNLKSKNVLVDEYFVAHLTDFGLAGLMSPNAAAEMMAAASLEGYKAPELQKMKKANTKTDIYSFGILLLEILMGKKP

SEQ ID NO: 736 - protein, 221 aa, Pinus radiata
RIALGAARGLLYLHDQCDPRIIHRDVKAANILLDEDFEAIVGDFGLAKLLDQRDSHVTTAVRGTVGHIAPEYLSTGQSSEKTDVFGFGILLLELITGQRALDFGNDSKQKGVMLDWVKKVYQEKKLDLIVDKDLKGFFDRVELEEMVQVALLCTQFHPAHRPKMSEVVRMLEGDGLAERWEASQKTETPSYRRAESIPRKYSDFIEDTSFAVQPMELSGPR

SEQ ID NO: 737 - protein, 113 aa, Pinus radiata
YKIARVACRCVRMRGKERPSMDKVTTELERALALLMGTPCDDQPILPTEVVLGSSRLHRRSSGSNDSELRAPSWITFPSVASSQRRKSSVSEENKNDHMCLRCLEGGERKPEN

SEQ ID NO: 738 - protein, 140 aa, Pinus radiata
FRLRLSYLSLSLNLTTSLPKAIGNLTTLTYLALYQSGLTHIPVEIANLTKLTSLVLHENNLTDIPESIAKLTRLTFLDVSHNRLANKIPEAIFNLTKLERLFLFSNMLIGDIPITLSNLSQLVVLDIHNNTLSGNIPSTI

SEQ ID NO: 739 - protein, 144 aa, Pinus radiata
AILFLLFIFSFSSSAHSFRDDRHSLMAFKKLISDDPYHYMADWSPAVPICNWTAVTCSRRHPLQNRVVSLNLSSIDLGGSISPYLGNLSFLHTLDLSNNSLHGHIPPQLGRLFRLKKLRLSYNQLEGSIPSEIHSCRNLVYMAL

SEQ ID NO: 740 - protein, 156 aa, Pinus radiata
DRVVAIDLDSMDLRGTISPSLGNLSFLRSLNISGNKLHGHIPPQLGRLFRLRWLWLYSNQLEGNIPHQLSSCRNLVWLSLSFNNLSGIIPGELGSLPHLQVLFLGANSLTDTIPSSLSNISTLTDLEISTNTSLAAFHKNWAFSLICKLFTFIQMN

SEQ ID NO: 741 - protein, 173 aa, Pinus radiata
IPASISSLRQLQSLDLSFNNLTGRIPNGIGGLGNLQTLSLSSNKLSGAIPASFKNLALLSYLDLSDNHLNGTVPAFIGNIKGLRYLDLRNNKFHGVLPFSTAFVKNLNTFKVGANPDLCFNASILSSTISGGAQPCDSKGRPSKGNADSPAYAPDELAGSPAPSTEVEQQHHH

SEQ ID NO: 742 - protein, 143 aa, Pinus radiata
RLSAKNMAAIFIAVCAVFSIVVVCCIMVRRRSCCCQRSSREQQQSIRAFMDPADSRPPSVENFLNYYSSQAPARYSYSQIITYTNNLEHKLGKGGFGTVYRGKLPNGHLIAVKILDESKQSEQQFIAEVATVGTTCHINLVRL

SEQ ID NO: 743 - protein, 257 aa, Pinus radiata
ELVGPIPSNLTNLQLTNLTVDSNKLSGPIPDLKLPPGGFTYSGNSFCQSVPGLSCAPAVAVLLDFLASLNYPIDLAGSWTGNDPCNSWIGIGCSTGTVSVINLPNRNLNGNISPSLVNLPSLKIIKLGGNKLSGTIPSTLTRLKSLSTLDLSHNNLSPPVPKFSGQVQVLTAGNPLIDKSSALPPVSPSVPPPSGSPPLPPSGSPPSPPSNGPPSNGSSAPVPSANGSTPSNPVSPASPAPPSGSSAGSNTNSSNSN

SEQ ID NO: 744 - protein, 127 aa, Pinus radiata
ENLSVAYRLRELKPGEKGLDWPTRKQVAFGAARGLEYLHEHCNPKIIHRDLKAANILLDEDYEAVVGDFGLAKLVDAKKTHITTQVRGTMGHIAPEYLSTGRSSEKTDVFGYGIMLLELVTGQRAID

SEQ ID NO: 745 - protein, 119 aa, Pinus radiata
RRIHSNSRDFETELEIICKLRHGNLVNLLGYCEEMGERLLVYEFMPHGTLHDHLHGGLSPLSWTLRLKISMQAARGIEYLHKDASPPIIHKDIKASNILLDGEWGARVADFGLTISGER

SEQ ID NO: 746 - protein, 120 aa, Pinus radiata
VLPSSMGDLVNLERLSIANNMIGGPLPASWGKLSSLTQLYMNDNKLSGSIPKSVGKISKLQFLYISHNNLSGSLPQELSELSDLQILDISFNNFKFESVPTVISRLPGLYELSLAGCGIE

SEQ ID NO: 747 - protein, 126 aa, Pinus radiata
RGWFCLRRKDDSEVYSENMEQADLVALDGQVSYDLDELLRASAFVLGKSGVGIVYKVVLEDGLTLAVRRLGEGGSQRFKEFQAEVEAIGRIRHCNIVTLRAYYWSVDEKLLIYDYIPNGSLAAALH

SEQ ID NO: 748 - protein, 176 aa, Pinus radiata
MVRFLQEISGTDHVETGNGENRRESIALVVIVVMASLAVVALLVAFSYYWYIKNKVKKRFNTEKSLQQSNELAPPVMNSSSQTEAQVFTFKQLQAATSNFSSNNVIGNGGFGSVYKGVLQDGSKVAIKQLDQASKQGEQEFRVEVDVLSCLHSPYLLALIGYCADHDHRLLVYEFM

SEQ ID NO: 749 - protein, 206 aa, Pinus radiata
MGCRWRNAVRLQFFQEFYVILLLHLAVRNCWSLNSEGMAMLAFRECVHMDPYNAFSNWNPYDEDPCKWRGVSCVNGKVISLELVDLSLQGILAPELGQLIHLQKLALGENNFSGSIPKELGELGNLELLNLRHNGLVGKIPSNLGNMSTIKSLLLTGNKLDGSIPPELGNLISLCELQLDRNQLSGFIPGFDPRNQKASKSVSLCG

SEQ ID NO: 750 - protein, 115 aa, Pinus radiata
KLFTNNLNGSLPSNLGKFSGLQTLDIAGNRLSGTLPPDLCKYGKLQTLNIFNNNFTGQLPLQYGACLSLQRVRISHNELMGQVPSSFWGLPHVYYLELSNNKFEGSISSEIRMPR

SEQ ID NO: 751 - protein, 224 aa, Pinus radiata
MTNTCNLPHFISIVIFLVLLLNVVNCKTLKRDVKALNEIKASLGWKVVYAWVGDDPCGDGELSPWSGVTCSHANQGEYRVVTELELYGVSIVGPFPVAVTSLLDLRRLDLHGNKLTGSIPPQIGRLKHLMILNLRWNKLQDSIPPEIGELKKLTNLYLSFNNLRGSIPKELGNLPELRYLYLHENRLTGRIPPELGILPNLRHLDVGNNHLVGTIERLIRKEGA

SEQ ID NO: 752 - protein, 179 aa, Pinus radiata
EKSFEWWVTLAEEDESEEPKKKEKSKSRERREWWREEFCEELSQKSNRSSRRVNSRSRSRDWFRDEPLPLHHHSRDWGSGDVMRSGVSSTPSMRGTVCYVAPEYGGGGALSERGDVYSFGVLLLVIISGRRPLQVMASPMTHFERANLISWARHLARSGNVLDLVDATLGEDYDKTQAL

SEQ ID NO: 753 - protein, 191 aa, Pinus radiata
FYVRRMFLGREVGGKVYKGVLADNIKGCSKTVRLTIIALVGSKHFYGRLTMISVAVHRNLFALDRILCCTIRAEANPYIQKKTEAYRQTKRKQTEKKANRPARKKKAGRTASPWEELHEQAKQKKNHPEGKETNEWLDEDLEAVVGDFGLAKLVDARKTHVTTQVRGTMGHIAPEYLSTGRSSERTDVFGY

SEQ ID NO: 754 - protein, 149 aa, Pinus radiata
SVQVLRHVTRNFSPENELGRGGFGVVYKGQLDDGTIIAVKRMEAAVVSNKGLAEFQSEIAVLSKVRHRHLVALLGYCIEGNERLLVYEYMPKGALSRHIFDWATNGLEPISWKRRLSIALDVARGMEYLHNLAHRSFIHRDLKPSNILL

SEQ ID NO: 755 - protein, 145 aa, Pinus radiata
KALTELGIFNTSVSGTIPGSISGLVSLRRLDLSGNRLKGPIPDGIGRCVALEHLVLSNNKLNGTLPSSLSNCTSLQRLKVSDNLLSGGLDIRFPVSMEVFSAHSNNFYGTLPASLAKCTKLQLLDVRHNGLTGELPYYLAYFDQL

SEQ ID NO: 756 - protein, 144 aa, Pinus radiata
FLSYNQFSGPLPSSVSLLDRLWRLDVSNNNLTGEIPFSLNLLSHLLTLRLENNLFSGTIAALNMTSLQDFNVSGNQLTGAIPGSLSKFPDSAFEKNLFLCGNPLPSCKSIITNPTTPGGIVNSSPVTQDPSIVPSTPSSKPEMA

SEQ ID NO: 757 - protein, 183 aa, Pinus radiata
NRFHLEIPSNLGNSPVSVVVFANNNLKGCVPPSLGKMAATLNEIIFLNNNLSACLPSEIGLLKNLTVFDASFNKLVGPLPDSIGQMDSLEQLDVAHNMLTGKIPQSICALPNLDNFTYSYNFFTGEAPNCLALPSRGVTFDDKRNCIPSRPLQRTLQQCSAFLSRPGVNCSASSCNPRRIFPS

SEQ ID NO: 758 - protein, 88 aa, Pinus radiata
VTIIGRIHHLNLVRMWGFCTEGEHRLLVYEYIPNGSLDKYLFDKQGKGETVGLDWSSRYRIAVGVARAIAYLHEECSEWVLHRDIKPE

SEQ ID NO: 759 - protein, 229 aa, Pinus radiata
LLVIVFVFFVLKHERRVAVGHTERDVNPPVRRGGQSVVGISVSLSSLGESFSYEQLLQATEEFNASNLIKHGHSGDLYQGLLEGGVPIVVKRIDLKSFRRDGYLAELDIFGRASHTRLVPLLGHCLEHEDEKLLVYKYMPNRDLSYALYKKGCSPEDTLQSLDWITRLKIAIGAAEGLSFLHHECSPPLVHRDVQASSILLDDKFEVRLGSLSEVCPQEGEAHQSVIAR

SEQ ID NO: 760 - protein, 172 aa, Pinus radiata
KLADFGLSRMGIEGEASYVTTTVKGTLGYLDPEYFSTQMLTEKSDIYSFGVVLLEIICGRQPVDAKLSEEETNLIRWVTPYVEMEEIPPKLAEIVDKRLGKDYDIKSITVVAKLAIRCVQAVPSSRPRVSKVVAELKEALKFEMDKDSLISKTDIEYGDFSPARSLYPSFEW

SEQ ID NO: 761 - protein, 136 aa, Pinus radiata
SGGFGTVYKLVMDDGNAFALKRIEKTSVGSDRVFERELEILGSVKHRHLVNLRGYCNGPSANLLIYDFLAGGNLDEMLHGTHDRPLDWDARVKIAIGAAKGLAYLHHDCSPRIIHRDIKSSNILLDRNLESHVPEF

SEQ ID NO: 762 - protein, 211 aa, Pinus radiata
MAYKLLRFWLEFQALLVLFPLALSVSQEGLVLLEVKKELSDPNGFLGNWKAEDDSPCKWRGISCDQRSKSVVGIDLSSGGLVGVFPSVVCNLPQLKNLSLGDNNIGSILPRNLSMCRQLQRLNLSQNLFVGNLPDFISELAELEYLDLSSNNFSGSIPAGIGKLPRLQVLNLCCNLLNETIPTFLGNLSNLQQLLLAYNPFAPGVIPPELG

SEQ ID NO: 763 - protein, 136 aa, Pinus radiata
SGHILQELSKLYSLAVLDVSSNSLCGPIPGGTQFSTFSATSFQRNKCLYGCPLDSCSEKENPVGEGDNNSSSAHMKMGWLEHLDEKMSLMALGIGFGIGIWGVVGVFIFCNRARHWVLGLPPNKPQLFYGMDRFPT

SEQ ID NO: 764 - protein, 323 aa, Pinus radiata
MDLLLLLLVMMGVAMPTHSQHTGGFTSVQRFPFNGRSMMGKPSIAGYHEKRDVEALLSFRKGITLDPYGWLSNWTANNSHNVCLWNGISCSPNTNRVVEISLRYGRLNGTLSPYIGNLSLLRHLDLSSNALSGRIPAEFGQLKALRILDLSNNALTGSIPTCIGNGGLNGTLDLDLSWNAFSGRIPKELFNCTRLQRIDLSHNSLTGSIPTSIGNCALLQTLNTGFNYLSGSIPTSLANCTSLTDLVISSNNLSGPIPSEFSGLVSLKFLFLDDNSISGSIPTSLVNCTSLFALKGSGNKLSGPIPSVMGLMKSISTIDLSNN

SEQ ID NO: 765 - protein, 184 aa, Pinus radiata
QFQTEVEMISLAVHRNLLRLCGFCMTSTERLLVYPYMLNGSVASRLRDSINGKPALDWPTRKRISLGAARGLLYLHEQCDPKIIHRDVKAANILLDEYFEAVVGDFGLAKLLDHRDSHVTTAVRGTVGHIAPEYLSTGQSSEKTDVFGFGILLLELITGQKALDFGRAANQKGVMLDWVSTIEF

SEQ ID NO: 766 - protein, 163 aa, Pinus radiata
MLLCFVLVAGTSAAVDDHQYLYHPSHYVMNERQESGSSMARHEKRDVEALLSFRNAITADPHGLLSNWTAHNSANICSWNGIGCRKQSRRVVSIYLRFSHLEGTLSPSVGNISLLHTFVLTVNKLTGRIPPEFGQLKALQTLDLYRNLLSSSGPGELGLLQKL

SEQ ID NO: 767 - protein, 157 aa, Pinus radiata
MRMFLLLVYLFPLVTPFAFSTVQLSNGSNAVDQEAVLGFLSAITNDPYQSLPTNWKSNVSVCEWTIIKCNGSRVVSLNVSSMGLEGTISPLLGNLSFLEKLDLRNNNFHGPIPYQLGSLVRLQMLILSSNKLQGSIPPTLSGCRNLRFLYLSANNLR

SEQ ID NO: 768 - protein, 154 aa, Pinus radiata; identical to SEQ ID NO: 99

SEQ ID NO: 769 - protein, 170 aa, Pinus radiata
MSRAGYLHFLFFCFVLTVRSCFAIRGWQDGLILQELKRGFDDPSGAFRNWNENDNSPCNWTGITCDAGEKFVEEVDLSSKNIIGPFPTVVCRIDGLKKLSLANNYVNGSIPAGLRRCHGLEYLDLSQNLIIGGLPDFISELFRLKHLDLSGNNLSGPVPPAFGRLPELQV

SEQ ID NO: 770 - protein, 224 aa, Pinus radiata
MKVRYGSWIVLLFFISCVYSADEDVEMDGKCVEADLAALVSFKFHIVEDKSEIFNSWSGNHCCAGWEGVECDFQNGRVVKLELQNHESSNDTMYMRGTLSPSLGNLAFLQVLVINGFKEIKGSIPATIGNISHIKQLYLENNKLSGLIPPSIGKLSQLETLSLNGNRLSGRIPDSMGNLQRLIQLNLAKNRLSGTIPPSIKNLGSLLFLDLNDNLLSGPVPAFL

SEQ ID NO: 771 - protein, 282 aa, Pinus radiata
MDSWRKNYALPVSLKPCVSSLTVMVIFSLVIPVFPTTFVFNEFNGTNLILEAGATLIPSRSAVALTNHTHWVIGRALYSTPVQMKSNGTLSSFSTTFVFSMVNPHLDAGGHGIAFFIAPNTTLMAGLASEYIGLVNGTNNGQAYNHLFAVEFDTTRSVELGDPNDNHVGVDINSLISVKTANAGYWNAEEFQGINLQCGSNIQAWIDYDSLQSQVNVTITLAGLPRPQKPLISQKIDLQNVLQENMFVGFSAATGNLVEDHYVLAWSFTTEGTASPLDISRL

SEQ ID NO: 772 - protein, 160 aa, Pinus radiata
MDLLLLLVMMFVCSVMMGVAMPTDGFTSVESVPFNGRNRHKRDVEALLSFKESIISDPYGSLTNWTANNSHNVCLWNGISCRPNTKRVVSISLPECWLNGTLSPYIGNLSLLRHLDLSWNALSGRIPAEFGQLKALRILDLSASHGLLHGYIPKELFNCT

SEQ ID NO: 773 - protein, 151 aa, Pinus radiata; identical to SEQ ID NO: 94

SEQ ID NO: 774 - protein, 61 aa, Pinus radiata
LELRCGRYFQGLFTERDENVIGSGASGKVYRVDIPNNETVAVKHLWTSTKMDMDDIYHGQK

SEQ ID NO: 775 - protein, 204 aa, Pinus radiata
MAKETVKVGFRLTAVACICVWTSIYTAFSQNAEPLAIRISCGSWENTHTPDTNMLWVKDYGYTGGSSANATTTSYIAPQLKKLRFFKLSDGPENCYNVTRLPNGHYSVRMFFGLNEDVLADREPLFDVSIEGTQVYSLKPGWSMNDDQAYVEASVFVLDTAATVCFHSTGHGDPSVMSIEILQLHPQAYDFGAQWGDTVIFRTA

SEQ ID NO: 776 - protein, 68 aa, Pinus radiata
DDELLQFMRVACACVLSGPKERPSMYEVYHLLRAIGEKYNFSDENDEILLASGTADNDYSNELIVSRE

SEQ ID NO: 777 - protein, 103 aa, Pinus radiata
MDKIPYGEWSRWIAFGSFLLVVNVISEPEGFLSITCGGEMNTTHNGITWVGDAHYIDVGNTAEITDLSENAYGSYLHTIRVFPKPLNKSCYQLPVVPDVPYLL

SEQ ID NO: 778 - protein, 100 aa, Pinus radiata
MAFASDIWRWRKLSVCLSSLVTFLYFFGLLSAVSDDGATLLAIKKSFRDSDNVLYNWIDSASSDHCSWRGVTCDNVTFAVVALNLSHLNLGGEISPVIGN

SEQ ID NO: 779 - protein, 93 aa, Pinus radiata
LGNSFKIESIWKIAEVAILSVEPSGSLRPRMHGVLQAIQEAIEIERGNETAEEGVPGSLAGHSMQSVLSSTHENAGSDASFSHSNRQLLPTVR

SEQ ID NO: 780 - protein, 130 aa, Pinus radiata
GNLTNLRSLNLSGNELEGPVPPVGILKSFNSSSFGVLHSQHRPRHTITVVVISVIVSAIISLLFCIAFILCYRVRRKNNINSEELPISMPGEPLIQRFTKRDLEMATESFSAGNIIGSSSISTVYRGVLR

SEQ ID NO: 781 - protein, 120 aa, Pinus radiata
MDHSAPLLLLILLSLCLLVSVSAALSINYSTSKPYSHTHAHQYLYDPIPGGLTSLQRHSDSERMVEEADFNLSAIDTHEKRDLHALLSFRKVITSDPMEKLSNWTADNSENICSWSGIRC

SEQ ID NO: 782 - protein, 117 aa, Pinus radiata
PVELGLMQNLEQLLLDGNYLSGNLPGQLGNLTQLTHLSLSSPNIYGSIPYEIFRLPLSYLSLTFDHTGSISKAIANLTKLTHLALPQMGLTTITEDIANLTELNYLDLSYNRLRVPI

SEQ ID NO: 783 - protein, 81 aa, Pinus radiata
EGGAAEDDSSTDKLVVLLNVAVSCVALSPDERPTIEEVLTVLEEDAIESHSCPGDFHGSSIPTEEQGMGDNTSERSWSEPE

SEQ ID NO: 784 - protein, 102 aa, Pinus radiata
MCPEEQVLRCIHIGLLCAQADATVRPPMSSIFLMLSSNSIALPTPTIPGFVRVTQTEESLAFNRKDVAALSRTSAASSSTSSHSPLVPSSRNDVSITQVEGR

SEQ ID NO: 785 - protein, 156 aa, Pinus radiata
MRERETKVCIFIFCIFTSWALVDFGVPAVFAAQETQIQILLRMKEALEDPTNALRDWDGSEDSPCRWRGIDCNDEGAVTRIQLHGSSLSGRILPDICNLQSLIIFELDRNSLYGNFPPEFSNCSRLEQLNLSSNLLNGSLPDLSKLKALKYLDLSN

SEQ ID NO: 786 - protein, 110 aa, Pinus radiata
MGSWEQSTVPSIAWKLFIIVLLLILVEDHAVVGDNASDKKALLAFKAAVGKRLNWSQSTNPCTPWFGITCVGSSVTEVRLPGRSLFGSIPSGILGNLSELRVLSLRYNSL

SEQ ID NO: 787 - protein, 235 aa, Pinus radiata
MANRHQILLLLSSFLLLVAVRTQAQDSQPNITGYACSSAPSPCKTYAFYKAQAPDFLNLRNISDLFGAVQSSHIANASGLPADTSSIADGQPLLVPITCGCMKNYSQANISYTIVKDDTFYGVSTRKFENLTTYQAVEVANPTLVPTDIQIGSLVTFPIRCQCPSKAQLGSGTKMLITYVVEKGDSLSSISKKFGAEQQNLKSQNGKNSTLDPYSTILVPLSKLPKLAQVLHHPH

SEQ ID NO: 788 - protein, 157 aa, Pinus radiata
MAFPCFYFPFRILFFLFVCSFSFSFSFSAHKFHDGRKWLLSFKIDITNDPHASMANWSPAVHLCNWTAVTCSRRHADRVVSLDLSGMDLSGSISPSLGNLSFLHTLNLSANALHGHIPPQLGRLFRLRNLWLRNNFLQGNIPTEFASLKHLQQLYLG

SEQ ID NO: 789 - protein, 144 aa, Pinus radiata
MGGLLHLTVLAVAVFLMVSLSQCGFELNDEVLGLIVFKADLHDPKSSLASWNEDDNSPCSWAGVVCSAKTGRVTEVVLDNLSLSGKIGRGLTRLPSLHTLSLANNNFSGDINISADLAQIPSLRIMNFESQCVLWCNSCRALSQ

SEQ ID NO: 790 - protein, 204 aa, Pinus radiata
MGRARVRPSPAATLALFLGAMSFLWATPHPLSNGFIPADDIHLSCGASGNQKDSDGRTWVTDKGSKFAPPDLSNFLSETASSQSPSLPSTVPYMTARIFKAPATYSIAVSPGQHWLRLYFYPSNYGSYQATDALFNVEANSYTLLHNFSSWQTANVLNMVSLLYEYSINVTSNKLNITFSPENPSSYAFVNGIEVESMPNLFDV

SEQ ID NO: 791 - protein, 68 aa, Pinus radiata
QFNPAHRPKMSEVVRMLEGDGLAERWEASQKVETPKYKGMEIISKRYSDFIDEDSSLVLKAMELSGPR

SEQ ID NO: 792 - protein, 144 aa, Pinus radiata
DASPQQCSSCAQEATITVQQLCENDIGGRVWFDVCFLRYDNFSFFSVLDARVFSILRNSQTVKDNPAGFQNDVKDLLGSLTDENSDLVSKGLAVQFAASSFSGTGRVFGLVECWRDLPIEDCKSCLLIALKKLYPFMVKEGGEA

SEQ ID NO: 793 - protein, 121 aa, Pinus radiata
LANCTNLFILDLGNNRFTGELPSYLAKFSKLSIFSVSYNNLHGTIPQWITNFTSLFLLDLSNNKFSGRIPSHLERLQGFTTDYFAQHTRGVYPIEMKVDIKGFEYNLTYVLLTNRIFDLSM

SEQ ID NO: 794 - protein, 163 aa, Pinus radiata
WIQSIIGSCIGGLAVLVAATAMLVGFLLKRKREFALATKNACDDSEFDRAEMGDLPIFSYKELEQATNYFDEKRELGGGGYGKVYLGKLRDGRNVAVKRFHENNCDRFKQFVNEVKILSSVRHCNLVRLFGCCKERENLLLVCEYVPNGTLFDHLHGAQRGKK

SEQ ID NO: 795 - protein, 104 aa, Pinus radiata
ATQVNSGNAMDLLDKKLMNIADAEQVRRAAIVGGWCIQDDEDARPSMSEVLQILEGITDVPPLPPLPLSLQNIALKPNSILRFFWETEPSAHERNDSDNPSTTL

SEQ ID NO: 796 - protein, 117 aa, Pinus radiata
MGNRHQMLLLLSSFLLLVAVRTEAQDSQPNITGYTCTNSSSTCETYVFYRAQAPNYLDLLNISSLFGVQRVQIATNSNLSTTTISVADGQSLLIPITCGCMGNYSQANITYTIFQGD

SEQ ID NO: 797 - protein, 100 aa, Pinus radiata
MASKSTSTLTLALVLSQFLYSAQLGEARTVAGDVEALKALKDSVDANSIQAGSCLSSWNFSADPCDSAFGKLFTCGLRCDGGRVTEVTLDESGYNGTLPP

SEQ ID NO: 798 - protein, 89 aa, Pinus radiata
MGQTMKLFYIILLLFIITVFPAKAVEESVCNHDFNYTKGSKFESNLNRVFKSLVQHTSQTGFNTSVDGQTYGLLQCRGDTTVDQCHNCS

SEQ ID NO: 799 - protein, 281 aa, Eucalyptus grandis
MDSKNSSPWSFILPIFLLCSSLYTHLCLGTDKLDANRSISGNQTLTSSGGNFTLGFFSPGNSTYSYIGIWYNKNKISVQTVVWVANRDNPVTDRHSTGLKVSGGNLVIVNNSEVPVWSTNLTASSSGSSSMVAVLEDDGNFALKAAPNSSVTLWQSFDYPTHTWLPGAKFGIDKRKNTSQRLTSWKNAEDPSTGLFSLNLQPFGEYYIWWNRSKHYWTSGTWDNQTKIFSLVPEMRANYIYEFKYVDNENESYFTYSIKSSFNTISRFVMDLSGQIKQESW

SEQ ID NO: 800 - protein, 264 aa, Eucalyptus grandis
MNPPSMSPVSIHHTLFFLLFLIPRPSLAQENIPVGSSLTATNGNSSSWLSPSGDFAFGFHSLSDGDTKKNQLFLLAIWYNKIPSKTIVWFANEDRPAPENSKLTLDSDSGLVLTNPQGGELWKPDTVIGTVSHAVLNDTGNFIILDSSSDVKWQSFDNPCDTLLPSQVLGKGKSLSSRQSEESFSRGRFQLRMRESGDLVLNTINLPSDYANEAYYSTGTDGSSNASTAGKELVFSNSGSLFVSRANGERLLLSQGGISPASDS

SEQ ID NO: 801 - protein, 175 aa, Eucalyptus grandis
MRVRRTLLVALAIVASFLFPVTGQDLASDRNALLALRSSLAGRTLLWDASQQSPCSWAGVQCQSGRVTSLPLPGASLSGQIPVGILGNLTGLKTLSLRLNALAGQIPPDLASCTGLRNLYLQGNRFSGPIPESLLGLRELVRLSLASNTLSGEISRSFSNLTRLRTLSLENNSLS

SEQ ID NO: 802 - protein, 345 aa, Eucalyptus grandis
MNTLPRSSLPPLFSAIPITLLLLFLPHSLSSPPNDTNALTLFRLEADTHGHLLSNWTGSDACSAAWRGVRCSSSTHSSSRVTALSIPSLNLRGPIDSLSSLDQLRLLDLHDNRLNGTVTPLANCTNLKLLYLAGNDFSGEIPPEISSLRRLLRLDISDNNIRGVIPGEVRGLSRLLTLRLQSNLLSGEVPDLSVSLKNLKELNLTNNELYGHLPDGLLRKFGVRSFVGNEGLCGSSPLAACSLSGTSPPASSSLTVPSNPSSMPETPAIGPGQKHRQKGLSTGAIVAIALANCVALLVVTSFVVAYCCSRERNSSLKANGESTGKRRSGSSHGSEKRSVCKRRCG

SEQ ID NO: 803 - protein, 114 aa, Eucalyptus grandis
MARFPLAILAILVSPLLFSAVAFSKTLKRDVKALNEIKASLGWRVVYSWVGDDPCGDGDLPPWSGVTCSSQGDYRVVTELEVYAVSIVGPFPTAVTNLLDLTSLDLHNNKLTGP

SEQ ID NO: 804 - protein, 248 aa, Eucalyptus grandis
MKLLQAVIPTTSLLFGVLLLIPLVVADLNSDVQALLGFASAVPHARKLNWSPSIPICSSWVGITCNVDKTRVTKVRLPAVGLYGSLPSNTLAKLDALEVLSLRSNYLTGNLPSDVASIPSLQYLFLQHNNFSGSLPISLSSQLNVLDLSFNSFSGGIPPSIQKLNRLAIFYLQNNSISGTIPDLNLPKLKLLNLSYNNLSGSIPNSLQKFPNSSFVGNSLLCGQPLSQCSTLATSPSPAPDTQNSNNR

SEQ ID NO: 805 - protein, 272 aa, Eucalyptus grandis
MAHFLGKLRSLLSLIVSLSLFFFFALPFASPVASLSTVSITETANRTLVCALIKTPGQSVFLNCTSFPAGIQIPANIDASFTGIVGGDGFLCGLRGKYFSTPSSLVCWRYSANGTEYSYRRIYRGPPVTELDSGDAHVCGLANGTSRLKCWQWRRFNRTPAPSNWSSVAVGGDYACGLMGTGKVACVGDNVPVVNNKRNGTFIAVAAGSGHACAISVDNKLECWGAAENDPPEGVFVSVALGENRSCALKDNGRVVCWGQGNFSLPEHLGDT

SEQ ID NO: 806 - protein, 95 aa, Eucalyptus grandis; identical to SEQ ID NO: 514

SEQ ID NO: 807 - protein, 1014 aa, Eucalyptus grandis
MRFSSLKRRRWIMRTAIIITSLMCCSSARDSMTLSSPLSDEHGDTLVSDGGTFQLGFFSPNGSSGSDHRRYLGIWYYDSDPQTVVWVANRDHPVLDVTGVLTLTQDGNLKVLDKAGKSYWSTNLEESSHLALKVQLLDTGNLVVARAGESGEAESGSGKMILWQSFDYPTDTFLPGMKMDENMTLTSWRSDDNPSPGNYSFQLDQEGQYQFVVWRRSIRYWKSGVSGKFITSDDMPYSISYFLSNFTTSIDNNASVPYLTSSMYIDTRLIMSSWGQVQYLKRDSEKVWAFVWAEPRDRCSVYNMCGDFGSCNSDADVVCKCLPGFSPSSPDLWNFGDFSGGCIRKSILCNKGSETFLGLKAMKVGKPDSEFVAADEMECKKECLNSCQCQAYSFEEGESAAGQGGSGGGVCWIWSENLNNLQDGYDEGRDLFVRIAVSDIESTARNCEICGTNLIPYPLSTGSQCGDPMYRSFYCNTSTGTVNFKSPSGTYQVTQIIPESRKFLIKSKQTDSCKVLEFNRSLPFHLSSSCRGKTSSKPEIEISWEPPPEPTCITSTDCTDWPDSTCSTTLDGRRCLCKPNFRWNPLLLNCTKGKKHEVLSSKKVPPSVVISITFACILVLIALLSTVAFIYIQRRNSGKKKGNWSNIRRYSARQLYDSERQVKELIDSGRFKEDSSNGIDVPFYNLESILAATDNFSNINKLGQGGFGLVYKGKFPGGQVLAVKRLSSFSGQGFEEFKNEVILIAKLQHRNLVRLLGYCVEGDEKILLYEYMPNKSLDSFIFDRTLCMSLDWNTRFKIILGIARGLLYLHQDSRLRIVHRDLKTSNILLDEEMNPKISDFGLARIFGVKEISVNTNRVVGTYGYMSPEYALDGFFSDKSDVFSFGVVVLEVLSGKRNTGFYQAEQGLSLLGYAWSLWKEEKSVDLMDPTLHKSCNMNEYLRCISVGLLCVQEDPNDRPTMSNAVFMLGNETATLPTPKQPAFVMRRCPSSGASTSSKLESCSFNELTVTLVNGR

SEQ ID NO: 808 - protein, 660 aa, Eucalyptus grandis
MGLARLLLVGFVLLVLGSRALVCGNAELEALMEIKASLDPENKVLTSWTSNGDPCGGSFDGVACNEHQKVATISLQGKRLSGKVPPAVAQLKCLSGLYLHYNSLTGEIPREISSLTELTDLYLDVNNLTGSIPSEIGSMASLEVLQLCCNQLNGTIPLQIKSLKKLSVLALQHNNFSGDIIGLADLQSLKSLDLAFNRFSGTFPVEIAKIPHLQTLDVRNNSLSGFVPTALKNLGERFNYQNNPGLCGSGFHSLRNCNNFGQNLIPKTADVKKHCNQSHCSEPSKLPQAALVAGIVSVTVTLVGAGLITFYRYRRGKQKIGSTADASDGRLSTDQSKDLYSRSASPLVCLEYSSGWDPLDDGRCGNGLSLQAPRYTLEEVESATQYFSEVNLLGRSTFSSVYKGILRDGTLVAIRSINVTSCKSEEVDFVNGLNLVTSLRHENLIRLRGVCCSKGRGECFLAYDFAPKGTLSQYLDLEDGSIQVLDWSTRVSIIKGIAEGIGYLHNGEGSKPAVVHQNISVEKILIDQQLNPLIMDSGLPKLLADDVIYSALKTSAAMGYMAPEYITTGRFTEKSDVFAFGVIIFQILSGKRLLSSSMRSAAECCSFENFIDSNLKGNFTEPEAAILGKIALRCTSELPDNRPTIFRVIEELNDWSVKRQ

SEQ ID NO: 809 - protein, 1133 aa, Eucalyptus grandis
METNPIHLIYHVFFIVIGLVSVSAAEQSASSRKTDAEALILFKKMIQKDPSGVLSGWQLDQDLCAWYGVTCYSGRVTQLDLHGQSLEATMSFDPLSSLDMLTVLNLSSNSFAIDSTSLLQLPYGLKHLDLSFVGLLGPVPENFFSKCPNLVDVNLAFNNLKSSLPENFFMNADKLQVLDLSYNNLSGSISGLKIENSCSLLQLDLSNNQLNESIPTSFSNCTSLHTLSLANNMFTGEIPHSFGRLASLQKLDLSHNHLTGWIPDELGTACNSLIELTLSFNNISGPIPLSFSSCSWLQSIDLSTNNISGPFPDSILRNLGSLESLLLSNNTISGLFPASLSYCKKLRIIDFSSNQFSGIIPPDLCLGAALLEELRAPDNLITGNIPPQLSQCSQLKKIDFSLNYLVGSIPAEIGMLENLEQLIAWFNGLEGEIPPELGKCRNLKNLILNNNHLKGEIPTELFNCSNLEWISLTSNELTGEVPREVMLLSRLAVLQLGNNSLSGQIPWELGNCSSLMWLDLSSNKLTGEIPPRLGRQLGAKGPAGIPSGNTLVFVRNVGNTCKGVGGLLEFAGIRPERLLQVPSLRTCNFARMYSGPILSKFTTYQTVEYLDLSDNQLRGKIPEEFGDMVALQVLELSYNQLSGEIPSSLGRLKDLGVFEASHNRLQGQIPDSFSNLSFLVQIDLSYNDLTGQIPQRGQLSTLPASQYEHNPGLCGVPLPECRNNEPETNPDVAMGTKGRAKPGTASWANSIVLGILLSIASICILTVWGIAMRSRRKEAEEMKMLKSLQAAHATTTWKIDKEKEPLSINVATFQRQLRKLKFSQLIEATNGFSAESLIGCGGFGEVFKATLKDGSNVAIKKLIRLSYQGDREFMAEMETLGKINHKNLVPLLGYCKVGEERLLVYEFMEYGSLEEMLHGRVKTQDRRILTWEERKKIARGAAKGLCFLHHNCIPHIIHRDMKSSNVLLDHDMEARVSDFGMARLISALDTHLSVSTLAGTPGYVPPEYYQSFRCTAKGDVYSLGVVLLELLTGKRPTDKEDFGDTNLVGWVKMKVREGKQMEVIDPAMLSTTKVQEEAEAEAEAEVVKEMVRYMEITLQCVDDFPSRRPTMLQVVAMLRELVPGSTTVSSNST

SEQ ID NO: 810 - protein, 717 aa, Eucalyptus grandis
MVFRRFVVMLFICTASVCAGLTDPRDVAAINSLYVSLGYPPLRGWLLVGGDPCVDNWEGVECVISNITGLNLSGANLGGELGDTLDFASLLSIDFSNNQIGGSVPSHVPPTILTMLLGNNHFSGIIPDSFEELTSLAHLDLSSNNLTGPLPPSFGNLSAVTTLHLQNNKLIGTLNVLEDLPLIDLDIENNLFSGPIPPKLMTIPIFKKGGNPFNTSVIPSPAPAPEPTSAPPPFIGQPPPSVPSKDGNGSRAEAPKSAHSEGGSRVKKVILIAVIGALVVVAITLLCLCLWRCSKKKQMNEMGEGHNMGVYANSQGAAKSKDSSRQPNIYTERQFPRKAVPEPLGKMGEDHGRAGLSNRQMDVTKALSLRQKKDQVGDSSLPLQPVVSPLAPPILNEKVIRNPVVSAQPTVRKRPSERTVSSPSVPFYSIASLQEFTNSFSPENFIGEGTLGSVYKAVLPDGRLLAVKKLKAAVSRHQSDEKFGDLVSRIYKIRHSNIVELVGYCAEHAQWLLIYQYCRNGTLYDALHLDDEVHGKLSWATRIRVAIGAARALQYLHEVCQPPVVYRNFNSTNILLDDKLEARASDCGLASLISSGSGSQLSEHLNPNGYTAPESESGAYSWQSDVYSFGVVMLELLTGRKSLDRSRPRGEQFLVRWAIPQLHDIDALSKMMDPSLSSFYPTKSLSRFADIISRCVQREPEFRPPMSEVVQDLLRMM

SEQ ID NO: 811 - protein, 633 aa, Eucalyptus grandis
MEGKHLVFLTILLLESICSNVSAIPNEDKQALLDFLGNVSLSRPLNWNKDSSVCRSWTGVKCNNDQSRVVALQLPGVGIKGRIPPNTLSRLSALQMLSLRLNSISGSLPSDFSKLKNLTGLHLQSNNFSGPLPSDWSVWPNLTFVNLSNNKFSGSIPPSISSLTYLAALDLANNSLSGEIPDLNLPKLQMLDLSNNDLAGRVPRSLQRFPSQTFVGNSVSFEVEALPPTLPAKPPSAGPPKKASKLSKTARLGIITGGCVLGAMAIALFMIMFCSSGGIKRRVLLKSQKQAASQNKREVAESQEKDNKIVFFEGCNYAFDLEDLLRASAEVLGKGLFGASYKAALEDATTMVVKRLKEVGAGRKEFEQQMEMVGRIRHENVAQLRAYFCSKDEKLLVYDFFREGSVSALLHGTGRERRGPLDWETRLKIAIGTARGIAHVHAQNGGKLAHGNIKSSNIFLNSEGFGCVSDVALAPLMNQIPLPLMRISGYRAPEITDSRKPTQASDVYGFGVLLLELLTGKSPMHATSGDEMVHLVRWVSSVVREEWTAEVFDMVLLRFPNIEEEMVEMLQIGMACVARMPEQRPRMPDMLRKVEEIRRAHVPTAQPSPDIKSPASTSTPSPTRPGAETAPAP

SEQ ID NO: 812 - protein, 623 aa, Eucalyptus grandis
MGVKRANSSLCCVVLLGLWACVHGLLSPSGVNIEVLALMDIRNLLVDPHQVLNNWDANEVTPCTWTAITCEADVVTNLEIPRQNLSGTLSHSIGNLINLKYLFLQDNNISGFIPPELGKLQKLEMLDISSNSFSGEIPTELSHLKNLQQLRMNYNNLSGAIPASFTNMTQLALLDLSNNSLSGPVPQLHAKTFSLQGNPMCVGRPKGDCFRIPPAPIIFSGNNSLNSQPSGRSKSHKVALAVGSTLSCISLLIFGLGFLFWWRRRHNQQIFFDVNEQHHEEINLGNLKKFHFRELANATNNFSGKNLIGRGGSGHVYRGCLSDGMVVAIKRLRNVDALGGDVQFQTELRMISLAVHRNLLRLYGFCMTQTERLLVYPYMSNGSVATRLRAKPTLEWSTRKRIALGAARGLLYLHEQCDPKIIHRDVKAANILLDDYCEAVVGDFGLAKLLDHRESHVTTAVRGTAGHIAPEYLLSGQSSEKTDVFGFGILLLELITGLRALEFGKAANQRGAMLDWVRKVHLEKKIEMLVDKDLKDNYDRIELEEIIQVSLLCTQYLPTNRPKMSEVVRMLEGDGLVEKWEASQRAESTRCRAANEFSSSERYSDLTDDSSLLIQAMELSGPR

SEQ ID NO: 813 - protein, 612 aa, Eucalyptus grandis
MAAPSSSAASAAVFALHSLLLLLLLAAAVEDDVLCLEGVKRSLGDPQGSLADWTFANTSASHICNLNGVACWNLNENRIISLSLTGFGVSGGLPESLKNCHSLQTLDLSQNKLDGPIPAQICEWLPYLVKLDLSSNSLAGPIPSQIGDCKFLNNLILSDNKLTGAIPYEVGRLDRLKVFSVRGNDLSGSIPSELSKFSSDDFSDNDDLCGRPLGSCGGLSKKSLAIIIAAGVLGAAASLLLGFALWWWYFSGASRKKRGYGAAADKDDSSWIEWLRAHKLIQVSLFQKPLVKVKLADLLAATNSFDSRNIVISTRTGVFYKAVLSDGSALAVKRLSACSIGEKQFKLEMNRLGQLRHPNLVPLLGYCVVEDEKLLVYKHMPGGTLFSHLHMNGQGTTGQYSSLDWPSRLRIGVGAARGLAWLHHGCQPPYLLQSISSHAILLDDDLDARITDFGLARLVNPRDSNDSSYRNGDLGEFGYVAPEYSSTMVASLKGDVYGFGVVLLELATGQKPLEICNVEQVFKGNLVDWVNNLTSSGRSKDAIDRSICGRGHDDEIVQFLKVACSCVVSRPKDRPSMYNVYESLRTIGERHGFSEADDEFPLIFKQDSDNKE

SEQ ID NO: 814 - protein, 990 aa, Eucalyptus grandis
MRVLFIVLGVVLLCTVIPGSSSSVSDVDVLLALKQGFQSPEPALITWSSSNSSSVCLWYGIRCSRGRVVSLELTDLNLGGSVSPLVSRLHSLVELSLAGNNFSGTIVIANLSSLKFLNISNNLFSGSLDWNYSSIANLKVFDAYDNNFTGLLPTGVIDLKKIRYLSLGGNYFQGEIPKSYGELAALEYLSVAGNGLNGKLPSELGNLTELREIYLGYYNVFEGGIPREFGSLINLVHMDLSSCGLEGVIPPELGNLKKLHTLYLQFNFLSGPIPKQVGNLTSLVNLDLSVNLLTGEIPFEVASLQKLKLVNLFLNKLHGSIPQFLADLPSLETLALWTNNFTGVIPEDLGRNGKLQYLDLSTNKLTGMIPRDLCSPNQLKILILFNNFLFGPIPEALGSCHSLVKVRLGQNYLNGSIPNGFIYLPQLKLMELQNNYLSGALPENVNRSSKPAMLNELNLSNNLLSGPLPSSLSNFSNLQILRISGNQFSGPLPAFTGDLRQVAKLDLRQNFFSGEIPPDIGNCYHLTYLDISQNNLSGPIPLTISKIPILSYLNISRNHLNQSIPEKISTMQSLTIADFSFNYFSGKIPESGQFALFNSSSFVGNPGLCGSVLDIKCNLTTFTSTSSRIHFTFKLMFAVGLLLCSLAFTTVAIIKARSFKRKAGAGSWKMTTFQKLEFSVQDILECVKDGNEIGRGGAGIVYHGKMPDGTEIAVKKLLGFGTNSHDRGFRAEIQTLGNIRHRNIVRLLAFCSNKETNLLVYEYMKNGSLGGVLHGKKGAFLGWNLRYKIAVEAAKGLCYLHHDCCPLILHRDVKSNNILLNSSYEAHVADFGLAKFLVDSGGSECMSVIAGSYGYIAPEYAYTLRVDEKSDVYSFGVVLLELLTGRRPVGDFGDGVDIVQWTKIATTNWRREEATRVVDPRLSLVPKDEATHVFFVAMLCVQENSTERPTMREVVQMLSEFPRHPPPEHYSSSSSSSTSSSSAFAKNFTG

SEQ ID NO: 815 - protein, 122 aa, Eucalyptus grandis
LHLMVFELVKNSLRAVQERFMDSDKVAPPIRIIVADGDEDVTIKVSDEGGGIPRSGLPKIFTYLYSTAKNPLDENSDLGIADNVTMAGYGYGLPISRLYARYFGGDLQIISMEGYDSQEPLP

SEQ ID NO: 816 - protein, 126 aa, Eucalyptus grandis
DSNMTSNEASENVTVMVSVEDTGIGIPLRAQDRVFMPFMQADSSTSRTYGGTGIGLSISKCLVELMGGHINFISRPQIGSTFSFTAVFGRCKRLVFANVKRTFEDLPSGFKGLKAIVVDGKPVRAA

SEQ ID NO: 817 - protein, 130 aa, Eucalyptus grandis
FILPTLRSANSKPQAHWSPSATPVFEQAGNNRHGGGSDAEEVGRVHQIIVHGGRVSWTGQFLQLQQLQDESNPDFVVEVVSLFFQDSEKLLNDLTSALEQQNVDFKKVDAHVHQLKGSSSSIGAQRVKNA

SEQ ID NO: 818 - protein, 153 aa, Eucalyptus grandis
MEVGQMQRRLVEFTKSLFMEGFLDGQFLQLQQLQDESNPDFVVEVVSLFFQDSEKLLNDLTSALEQQNVDFKKVDAHVHQLKGSSSSIGAQRVKNACVVFRSFCEEQNLEGCMRCLQQVKQEFYLAKNKFETLFTLEQQILAAGGSIPATEIT

SEQ ID NO: 819 - protein, 35 aa, Eucalyptus grandis
MEVGQMQRRLVEFTKSLFMEDSEKLLNDLTSALEQ

SEQ ID NO: 820 - protein, 139 aa, Eucalyptus grandis
FVTVHLAQEVMDSLDVETESSSKNTLSGFQVAERRLSWAKFKTFSQHECVCSYPSSTYDLINLIVSVEDTGVGIPFEAQCRVFTPFMQVGPSISRTHGGTGIGLSISKCLVELMNGEVGFVSIPNVGSTFTFTGGFNNG

SEQ ID NO: 821 - protein, 110 aa, Eucalyptus grandis
FREVLNLIKPVASVKKLLITLNLAPDLPEYAVGDEKRLMQVILNVVGNAVKFSKEGGISITAFVAKAEYLREARPPEFIPVPSDNHFYLRVQVRDSGSGINPQDIPKLFT

SEQ ID NO: 822 - protein, 185 aa, Pinus radiata
MDTDLDATQKDYAQTAQASGKALITLINEVLDQAKIESGRLELETVPFHIRTVLDSVLSLFSAKTQAKGIELAVFVSERVPEIVIGDPGRFQQIITNLVSNSVKFTENGHIFVCVHLAQEIDVLTHRLSAYKKIGEDPAINNYSLSNTLSGSEAADTRNNWESFKILHEIGSDELFSESDGRGRI

SEQ ID NO: 823 - protein, 148 aa, Pinus radiata
GSSQSTGTLPEKESANVFPDNFTDRDYINILQSMGQAVHIFKPSGEITYWNHSAEFLFGFSESEVLGQNAMELLVDQSNFNIASSMIHRIMAGESWKGQFPLKKKSGELFSAVMSNTPFYDDDGTFIGVICVSTDVCPFQKPPGLQLG

SEQ ID NO: 824 - protein, 265 aa, Eucalyptus grandis
LEVRSFSMHDMIREAACLAKCLCIYKGFSFELDIDRSLPNNVMGDERRVFQVILHMIGNLLNDSNQGKLVTLRILREKASGSQGRYDRGWVTWRSESTDRGVRIKFEVGISDDISLLERSVSTIQLGGRKYNSDGVEEDFSFSICKWLVQLMQGNIWVVPNTQGFAQSMTLVLRFPLRESISVTISEPGPSPDYTLSNSVFTGLKVLLVDSDDANKAVTRKLLEKLGCKVSTASSGFECLGALRPSESSFQIVLLDLHMPSRRGR

SEQ ID NO: 825 - protein, 90 aa, Eucalyptus grandis
LLRSCQYQVTTTNQAIMALKMLRENRDKFDLVISDVNMPDMDGFKLLELVGLEMDLPVIMLSAYGDPKLVMKGITHGACDYLLKPGRRGR

SEQ ID NO: 826 - protein, 142 aa, Eucalyptus grandis
LFTKFAHNQSLATRNSGGSGLGLAICKRFVTLMDGHIWIESEGIGKGCTATFIVGLGIPEKLNESKFPILPRGSSNHVLANFSGLKVLVMDDNGVGRAATKGLLLHLGCDVTTVSSGDELLRAVSQEHKVVLMDICTPGIDS

SEQ ID NO: 827 - protein, 816 aa, Eucalyptus grandis
EDERAFKTLVILISASLCTLVIGCLCIFLLTNGVSKEMKLRAELISHLDARRRAEASSNYKSQFLANMSHELRTPMAAVIGLLDILVCDDCLTNEQYSTVTQIRKCSTALLRLLNNILDLSKVESGKLVLEEAEFNLARELEGLVDMFSVQCINHNVETILDLSDDMPKLVRGDSARVVQIFANLISNSLKFTPSGHIIIRGWCGNSRTMSDFVKLPLEHKISISSLKTKLKQHGSHARRASKKDNKVTLWFEVDDTGCGIDPSKWESVFESFEQADPSTTRLHGGTGLGLCIVRTLVNKMGGEIKVIKKNGPGTLMRLYLLLNAPVDGTEHNCSVDYAVHNIRVLLAQHGSTGRFIMSGWLRRNGVSTLEASGWNELTQILQELYQGRNSGAPYRTVNTEHAHELPRSEVTTFDDIQSEILIIVVDIELLDLNTDIWKEQLNFLDKYHRKAKFAWMLNHDTFNAIKVELRRKGHMLMVNKPLYKAKMIQILDAAIKERNSELLKRASNSSKSMNKEEDLHECLEIDSEHYEGASSDELDTVETSRSGCTNTSPGEQKQQEGIKTPPALQHRTSNYHSFNSTLLSSDYNNLGNKEEACPTSPPLDHPDNAEGRFKCTRSVFSSKEKEDGNSEAQEQLLISKRPPAKVDSCSSKELDQKGSLEGLCILLAEDTPVLQRVATIMLEKLGAKVIAVGDGLQAVNALNSSLDVDAEDFRTTLHLQNANRMPQAGTRSWQPYDLILMDCQMPQMDGYEATKAIRRSEAGSGLHIPIVALTAHAMSSDEAKCLEVGMDAYLTKPIDYKLMVSTILSLTKGVN

SEQ ID NO: 828 - protein, 129 aa, Eucalyptus grandis
ADDALEYVSTLNFGDPFRKHEMRCRFKQKPPWPWLAITTSYGFLVIAMLTGHIFYATVNRIAKVEDDYQKMMELKKQAEAADIAKSQFLATVSHEIRTPMNGVLGMLHMLMHTDLDVTQQDYVRTARPV

SEQ ID NO: 829 - protein, 137 aa, Pinus radiata
EVPLHELATARVFCFGVFEVDAETGELRKQGLHIRLQGQPTQILLMLLNRAGDVVSREEICRRLWASDTFVDFDQSLGTALRKLRQALCDDAETPRYIETIPKKGFRFVAPVERISAPRRGATAVLPIRAINKKKKK

SEQ ID NO: 830 - protein, 57 aa, Pinus radiata
TDCRSARIIWDDIHISSQTETTSQKVRTVKSKSSMISQDSCSSPRRILLVEDTQINR

SEQ ID NO: 831 - protein, 53 aa, Pinus radiata
IIFGRVLQSLNLYCEEAENGKVAVDYFKQGRTYDLVLMDKEMPVMDGHEVCNC

SEQ ID NO: 832 - protein, 119 aa, Pinus radiata
GYLGSTSSVQPVNFYLFWFIEVAVPQHLVLGHQYLSGTEGGDGLYFLRAGLNWVLLIMGVALVACLAIFGMVWKRRRTWSYCGAMQKEDASQRAQEAQCSKGCMTNVLPNTRPVEEHTL

SEQ ID NO: 833 - DNA, 4056 bp, Pinus radiata
ctcctctgcagcagattatacccaaaaaatcattggggtttcatgttgttgtatgggccctctgaaactccatggccttggagcaactaatgataaggatcagtgatgtggggacgaaataatggaactcctgagcattttctgcttttgtgaggtactaaaattctgtatgattccattgcgctgaaaccaagaactctgtctgtctgatcaggctgtatcatggcctacaagcttttgagattttggcttgaatttcaggccttactagtcctctttccattggctctgagtgtctctcaggagggcttggttttgctggaagtgaagaaagaactgagtgaccccaatggatttcttggtaactggaaggcagaggacgattctccctgcaaatggaggggtatctcatgcgaccagaggtcaaaatcggtggtggggattgacctaagcagcggaggtttagttggggtttttcctagtgtcgtttgcaatcttccacagctgaaaaatctgtcgttgggggataacaatattggctcaatattacctcgcaacctttccatgtgcaggcagcttcagcgcttgaatttatcgcagaatctttttgtggggaaccttccggactttatttcagagctcgcagagctggaatacttggatctctcgagtaacaatttctctggttcgattcctgcaggcattgggaaactgccaaggcttcaagtactgaacctgtgctgcaatctgctaaacgagacaatcccaacatttctgggaaatctcagcaatctgcagcaattattgctggcatacaatccctttgcccccggtgtgattcctccagagctggggaagctagcaaagttacagaatctatgggctacttcttgtaattttgtgggtgctattccggattctattggcaatctgctgtctttgacgaatctggatctttcttcgaatcagctctcgggaattattccagaggccatcacaaagttaaatcaaatagtacagattgagctctatcataacaacttaacaggaaggattcctgagaactgggctaatcttgtttctctcagacattttgatgtctcaacaaatatgcttaacgggaccatacctgagcagttggcaaggttgccactttcgtccttgaacctgttcgagaataatttggtaggcaccattccggaggctattgggtattctccaactctgtctgagctcaagctgtttacgaataacttgaatggtagcttgccttcgaatttggggaaattttccggcctacaaacgctagatattgcaggaaatcgactgagtggtactcttccgccggatctttgcaagtatgggaagctgcaaactttgaatatctttaacaacaacttcactgggcagttgcctttgcaatacggtgcatgtttgagccttcaaagggtgagaataagccacaatgagctcatgggacaagtgcctagttcattctggggtctccctcacgtttattatctcgaactcagtaacaacaagttcgaaggctcgatttcttctgaaattaggaatgccaagaatctatcagcgctattgatatccggtaaccgtttctccggcaccttaccttctgagatagggcttgtggctaatctttctgtaattgatggtagccacaatcaattcacaggtcctcttccagccactttgggttcgctgaacaaattgagtaagttgcatctcttccagaatcagttctccggtagccttctcactgacatactgtcatggaatgagcttacagacctaaatctgtcaaataacagattctcgggccctattcctaaagagctaggggagctgccagttctgacatatctggatctttctgttaatgccttgacaggagaaatccctcctgaattgggcaatttgaagcttaacagtttcaatctttcggataatcagctaactggcattgttccttctgctttcagtctcagtttttacaagtcaagtttaatgggcaatcctgggctttgcagcaatgatggtcttaaagggtttaagtcctgttctgacatggagaatagcgggagaaaaaagtgttacagttgggcatggctgctcccagcactgtttgctttggctggggtcatttttgtgttaggactggccttgttttatagacaataccgtgaatacaataaagctaaagttaaagatttgtggcgaagcaataagtctccctggatgctgaccacgtttcaccgattgggtttcagagaatatgaaattctggattgcatagacgaggaaaatgtgattggaagtggtggatcaggaaaagtgtacaaggccacactcgggaatggagaaactgtggccatcaagaggctgtggaacaatggaaatgctgaaggctctacatcctgcaatgataatggattcaaggcagaagttgaaactttgggaaatattaggcataaaaacatagtgaaactctggtgttgctgtgtcaatgacgattctaatcttttggtatacgagtacatgcctaatggcagtttgggggatctccttcatggccccaaagctggtgaccttaattggcctacacgttacaaaattgcagttggagcagctcagggtttggcttatttgcatcatgattgtgtacctcctatcatccatcgcgatgtgaagtccaacaatattctgctagatgctgattttggtgctcgtgtggctgattttggacttgccaaggtccttcagagctatgagaagggaatcgatttcatgtctgcaattgctggatcctatggttatatagctccagaatatgcatacactctcaaggtgaatgagaaaagtgacatctacagttttggagtggtgcttctagagctagtgacgggcaagcagccggtaattcaggattttgaggagagtaaagacgttgtaatgtgggtgcgcactagaattgagaagcaaaatgatgggttacaggacatactggattctagagtaatggtagattgcttcagggaagaaatggctgcagtcctcaaagtggctcttctctgtaccagtgctttgcccatcaatcggccatctatgaggagagtgttggagttgctgcatgaggctggccaactgcacaatgttaaggatgttgttactaaggatctaaatctatttccataagctttttttaggcataactattaatggacaccaagtattaagatccaacgacatgttctggctctgaatgagcagttgggcatgagttgatctctagaagatccctgcaattttcttttctttttgttgtgtgcattctagaagttcctatgactataaaactcctcttttctcacacactctctcttctcagagtgcatcttgaaatagtttctgcttctttcaaagttcctcttccctcttttttcttgttatggtatggatcttgaattgctttctaccattaagagagcacatctctcttttttcaccatagaagttctatatattctgtcttaaacgtgagctgttgcttagttctgtacttttgccaagtgagaagtacttggcttttgtaaaacaaattagagaaagatgtagctgtagttctctagttttgccaagtgagaagtacctggcttttgtaaaacaaattagagaaagatgcagctgtttaattctgtgcctatttgactgtgaaaaatgaaagctaatgtgcttcaatggcagaaagacaattatgttgtacaccattatatagctttgtattatgttgaaggctttatgcttgagaatcaagttatttcctgaacaacattacatttcttatgtcaaatgaaatagttataattctctcgtgccgaattcggcacgagattttctttcccttctgaaacagatgctttcactagcattgaaaaaaattagtagatggtaaataatttttttagaatttttaccatgaagcaattcatagagggaaaaaatagtaaggttttaaacattcctcataaaaaaaaaaaa

SEQ ID NO: 834 - DNA, 2604 bp, Pinus radiata
atagagtgagaaatacagagcctaatctgaaggaagttggagtgatagagtgagaaatggatcttcttcttctcctgcttgtgatgatgggtgtagcaatgcctactcattctcaacacacgggtggattcacttctgttcaacgttttccttttaatggacggagtatgatggggaaaccctccatagccgggtatcatgaaaaaagggatgtggaggcacttctcagcttccggaagggcatcacattggatccatatggatggctctccaactggacggccaataactcacataacgtctgcctgtggaacggaatttcgtgcagcccaaacacgaatcgagtggttgaaatttctctccgttacggccggttgaatggtacgctctccccgtatattgggaacctctctcttttgcggcatttagatctttcttcgaatgctttgagtgggagaattccagcagagtttgggcagctgaaagcgctacgaatacttgacctctccaataatgctttgaccgggagtataccaacttgtatcggcaacggcgggttgaatggtacgctggatttagatctttcctggaatgctttcagtggaagaattccaaaggaattgtttaattgtacacgtcttcaacggatcgacctttcccataatagtttgacagggagtataccaacttctatcggcaactgcgctttgctccaaacgttgaatactggattcaactatttgagtggaagcatcccaacttctctcgccaactgcacttcacttacagatttggttattagctccaacaatttgagtggtccaataccatcagaattcagtggcctggtcagcttgaaatttctcttcctcgacgacaatagtataagtggaagcatcccaacttctctggtcaactgcacttcgctctttgccttaaagggcagcggaaacaaattgagtggtccaatcccttccgttatgggtttgatgaaaagcatatctactattgatttatccaacaactctctcactggccgcatccctacgaccctggtcaattgtactcagctatatgagttgtacctaagcactaacaaccttagaagtagcattagcattccccccagtattaccgatacggatttggtttatctcgacttatcaaacaaccagttaattggatctctccctcgtaacataggtcaattaagcagtcttcaatctctcgttttatcaaataacaatttgactggatctctcccgcataacataggtcaattaagtgatcttcaacgccttgatttatcaaataacaatttgactggatctctcccgcttagtataagtcacatagaggatttacaagaactagatctatataataataatatttttggcactatacccaatacaattagtttgacttcccttcagattttagatttatcaaagaacaatttagatggatcaatccctgaacttaatggtagttgccccgagttaagttttttctctgttcacactaataaactttctgggactttgccaatgtttttggctaattgtattgaaattcagtatttagatttaagaaaaaacaatttgacagggcaccttcctcactatttgaaatctttttcagaattgttaattttaaactttggctataataattttcatggtggcattcctgaatgggtaacaaatttcacctatttgtatgtattggatttatccaataacaaatttagtggaagaatgccattacattttgaaaggcttcaaggatttgtaaattcttcaaacaatgatgactccgaagaaaaagaaatcacagttcacatgaaaggatgtgagtatactctgccatacatctcatcagaaaacacaatacttgatttgtccaacaataatcttgtaggacaaatacctccaagcataggaactttgagagacatgcgattgctaaatttatctggcaaccagttggaagggctaatccctgcatctcttagcaacatatctactttggagcagttagacttgagcaagaacaatttgagtggacatattcctcaagagctctctaaactatacagtctggctgttctggatgtttcatctaatagcctttgcgggccaatccccggaggaacacaattttccacattcagtgcaacatcatttcaaaggaataagtgcttatatgggtgtcctttagattcatgcagtgaaaaggaaaacccagtgggagaaggtgacaataatagtagcagtgcccatatgaaaatgggatggcttgagcatttagatgaaaagatgtcattaatggcattggggatcggttttggtattggaatttggggagtagttggtgtatttatcttttgcaacagagctagacactgggtgttgggtctaccacctaacaaaccacaactcttctatggaatgtatcgattccctacataaagaaccaagtaatggatgttggctctagtatgtggtgaattaaattgtcatgtaatctaccaatgatatttttggtatactatcttatcacatatataaattttagtgtgatcaaaaaaaaaaaaaaaaa

SEQ ID NO: 835 - DNA, 2376 bp, Pinus radiata
gctgaacataactgttttgcccattctgattttgctgaagcaccaaggcttcataagagcaaaatggaagtacggatgataaccataatgatattatgtgctgctttactatgtgaagggagcggagaggtggatgttctgatggagatgaaagctgcattggaccccaagggggagatactctactcttgggtgaagggaggagatccctgcagtgggacttttgatggagtggcctgcaatgagcaaggaaaagtggctaatgtttctctgcaagggaaaggattatcaggctcaataccctcaaccattggcaagctcaagtgtctcactggactttatttgcattacaacagccttggaggggagatacccagagagctttctaacttaactgagctgctggacctttatcttaatgtcaatgggctctctggtcccattcctaaggagctgggagccatgtccagcttgcaagcactccagctgtgctgcaacaagttgacagggcctatacctatggagttgggatctctgaagaagctcaatgttcttgccctgcaaaataaccatttaaacggtgcaataccagcatcattgggagtgctaacctcgctgacaaggctggacctcagcttcaactcactttttgggcccataccgacaactcttacagacctccctcatcttgctattttggacgtcaggaacaatagtctctccggaaagactcctcaaggttttaaacgaatgcaagaaggattcaggtatggaaacaattcaaagctctgtggagaagagtttgctgggcttgcaatgtgtaatggaagttctccattaataaggccagaacctttcggctcacgggcaccaaatctaactgtcaaatctcctggagactcctctgtgcctccgttgcagaaaattccggagtctgcagatttctcaagaagttgccaaaattgctccaaaacgtttaaaaccccaagcattgccattgtcgtggctgtgattgctttgataggtggaggaatcctggcaaccgttttcacattctcatggtttcgaagacgaaaacagaagattagcagtgcttacgagacagcagacagtagactaagtatcgataattcgaaagattttggaaggaaatctatcactccattgattagtctagagtactcgaatggttggaatcctttggcagatgacggaacaggatgtgaacgcttccagagctctagatttaacctcgaggaaattgaatctgcaacacagtatttctctgaaaagaatctgctggggaaaaacaactattgtgctgcttacaagggggtattgagagacgggtcttttgtggtcatcaaaagcatcagtaaaatgagttgcaagacggaggaattagaattccaagagggtctcaagactctttcgctacttaggcatgaaaatgtggtgaggttaagaggcttttgctgttctagaggtagaggcgagtgctttcttgtgtatgattttgcacccaacggcaatctattgcagtttctggatgcaaaagatgggagggtactcgattggcctgccagggtaaggattgcacatggtgttgcgaaaggcattgagtatctgcatgaaggcataagcaaagctgttgtgcatcaaaacatctcagctgagaagattcttcttgatcaacacttaaatcctcttctttcagattgtggtctgcataaactattagcggatgacattgtgtattcaatcctgaaatcttctgcaggcatgggatatttggccccagaatacaccacagttggtcgtcttacagagaaaagtgatgtgtatgcttttggaatcatactgctacagcttctcactggagaaacaaggataaactcttcttcaataaggtctcttgtacaatctgggagaccggatgaattcattgatataactctcggaaaggagtactcaaaagaagaggcttctaatttagcacgcattgcattggactgcaccaatgaggttgctgctcaaaggcctcctatcagtgttgtactgcagaaactcgcttggattgatgacaaggaacaatgatgcctacttcaattcacttgatcaggcatggcaattttagaatgtggattcatccaaacatctctgtttggtcttttggttaaagatccatatccacgtgtataagtttttgcattacttgaaacattcattaacactcggggatctttcaaatccttcgatccggaattcaaataccttttttttcttcctgtatagattatacagatgtcaacatttaaccaagaaaacaaattaaccactcgaaagtggatttcagttaaaaaaaaaaaaaaaaaa

SEQ ID NO: 836 - DNA, 1209 bp, Pinus radiata
ggaagttggagtggtagagtgagaaactgacagcctaatctgaaggaagttggagtgatagagtgagaaatggatcttcttcttctcctgcttgtgatgatgggtgtagcaatgcctactcattctcaacagacgggtggattcacttctgttcaacgttttccttttaatggacggagtatgatggggaaaccctctctgttcccatcctccatagccgggtatcatgaaaaaagggatgtggaggcacttctgagcttccggaagggcatcatatcagatccagttggatcgctctccgactggacggccaataactcacataacgtctgcctgtggaacggaatttcgtgcaggccaaacacgaaacgagtggtttcaatttctctccctgaatgcttgttgaatggtacgctctccccgtatattgggaacctctctcttttgcggcatttagatctttcctttaatgctttgagtgggagaattccagcagagtttgggcagctgaaagcgctacgaatacttgacctctccggtaatgcgctccacggatatattccaaaggaattgtttaattgtacacgtcttcaacggattgtaggacaaatccctgcaagcataggaactttgagagaaatgcgattgctaaatttatctggcaaccagttggaagggccaatccctgcatctcttggtaacatatctactttggagcagttagacttgagcaagaataatttgaatggatcaattcctgaagagctctctaaactatatagtctggctgttgtggatgtttcatctaatagcctttgtgggccaatacccagaggaacacaattttccacattcagtgcaacatcatttcaaaggaataagttcttatatgggtgtcctttagattcatgcagtgaaaaggaaaacccagtgggagaaggtgacaaaaatagtagcagtgcccatatgaaaatgggatggcttgagcatctagatgaaaagatgtcattaatggcattggggatcggttttgggattgtaatttggggagtagttggtgtatttatcttttgcaacagagctagacaaagaaccaagtaatggatgttggctctagtatgtggtgaattaaattgtcatgtaatctctcaatgatatttttggtatactatcttatcacatataaaaaaaaaaaaaaaaaaaaaaaaa

SEQ ID NO: 837 - DNA, 2691 bp, Pinus radiata
ggagtggtagagtcagaaatggatcttcttctgctcctcgtcatgatgtttgtgtgctctgtgatgatgggtgtagcaatgcctacggatggattcacttctgttgaaagcgttccttttaatggacggaatcgccataaaagggatgtggaggcgcttctgagcttcaaagagagtattatatccgatccatatggatcgctcaccaactggacggccaataactcacataacgtctgcctgtggaacggaatttcgtgcaggccaaacacgaaacgagtggtttcaatttctctccctgagtgctggttgaatggtacgctctccccgtatattgggaacctctctcttttgcggcatttagatctttcttggaatgctttgagtgggagaattccagcagagtttgggcagctgaaagcgctacgaatacttgacctctctgctagtcatgggctcctccacggctatattccaaaggaattgtttaattgtacacgtcttcaacggatcgacctttcccataatagttttacagggagtataccaacttctatcggcaacagcgctttgctgcaaacgatgaatcttgcagagaaccagttgaggggttctatcccagcagaattcggccgtctggtccacttggaatctctccagttgtacagcaatactctgagtggaagcatcccaacttctctcgccaactgcacttcacttataaaattggagctgagcgacaacaatttgagtggtccaataccatcagaattcagtcgcttggtcaggttggaaacactcttgttcgatgacaatagtataagtggaagcattccagcttcgattagtaactgcacttcacttcaatatttggatatcagcgacaacagtttgagtggtccaataccatcagaattcagtcgcctggtcagcttggaatcactctacttccacgacaatagtataagtggaagcatcccaacttttctggtcaactgcacttcgctctctgcattgggggctagcggaaacaaattgagtggttcaatcccttccgttatgggtttgatgaaaaacatatcatttattgatttatccaacaactctctcactggccatatccctcccaccctattcaattgtactcacctatcttctttgagcctagcgactaacaaccttagaggtagcattccccccattattattaccaatactgaattgatggatctcgacttatcaaacaaccagttaattggatctctcccgcgtaacataggtcaattaagcaatcttcaatctcttgatttatcaaataacaatttcactggatctctcccacgtaacataggtcaattaagcaatctttacttgcttgatctatcaagcaacaaattcactggatctctcccgcttagtataagtcacctggatttacaagctctatatctatataataataatatttctggcactatacccaataatattagtttcagcgacattcaaattttagatttatcaaataacaatttagaaggatcaatacctaaacttattggtagttactgagttttaaaaattttctctattcacactaataaaatttctgggactttgccaatgtttttggctaattgcactcaaattgagtatttagatttaaggaaaaacaatttaacagggcaacttcctcattttttggaatatttttcattattgaaaattttaaactttggctataataattttcatggtggcatccctgaatgggtaacaaatttcacctatttgtatgtattggacttatccaataataaatttagtggaagaatgccattacattttgaaagacttcaaggatttgtaaattcttcaaacaatattccttttggagtctcaggtgaaatcacagttcacatcaaaagatgtgagtatactctgccatacctctcagaaataaacacaatacttgatttgtccaacaataatcttgtaggacaaatacctgcaagcataggaactttgagagacatgcgattgctaaatttctctggcaaccagttggaagggccaatccctgcatcttttggtaacatatctactttggagcagttagacttgagcaagaataatttgaatggatcgattcctgaagagctctctaaactatatagtctggctgttatggatgtttcatctaatagcctttgtgggccaatccccagaggaacacaattttccacattcagtgcaacatcatttcaaaggaataagtgcttatatgggtgtcctttagattcatgcagtgaaaaggaaaacctagtggaagaaggtgacaataatagtagcagtgcccatatgaaaatgggatggcttgagcatctagatgaaaagatgtcattaatggcattggggatcggttttgggattggaatttggggagtagttggtgtatttatcttttgcaacagagctagacactgggtgttgggtctaccacctaacaaaccacaactcttctatggaatgtatcgattccctacataaagaaccaagtaatggatgttggctctagtatgtggtgaattaaattgtcatgtaatctaccaatgatatttttggtatgctatcttatcacatatataatttctagtgtgaaaaaaaaaaaaaaaaaaaaaaaaaaaaaaa

SEQ ID NO: 838 - DNA, 2175 bp, Pinus radiata
gtttttctcatgctgctgtgctttgtgctcgttgcagggacctctgctgctgtagacgatcatcaatatctgtatcatccttctcattatgttatgaatgagcgccaggaatctggaagctccatggcccgccacgagaaaagggatgtggaagctcttctctccttcagaaacgccataacggccgacccacatggattgttgtccaactggacggcccacaactctgccaacatatgctcgtggaatgggatcggctgcagaaaacagagcagaagagttgtttccatataccttcgtttctcacacctagaagggacgctttcgccttctgtgggtaatatctctttactgcacaccttcgtacttactgtcaataaattgacagggagaattccgccagagtttgggcaacttaaagccctccaaacgcttgacttgtaccgtaatcttttatcaggttctgttccaggagaattggggttgctacagaaacttgagaacttgcacttacacggcaacaatttggagagtattattcctccgtctcttggaaactgctcttcccttacgtcactgtggatggctgggttctattcccgcagagttctattcccgcagggttctattcccgcgggttctattcccgcggagttaggaaactgcagccatcttagttctttatctttagttagatttagattaacaggttttgtaccggatttcatataccgccttcccctttccgaactggaccttagattcaataaccttacagggaagttacctaaagctattgctaatttgagtcacttaacttcactccaacttggttcgaataactttataggaagcatccctaaagccattaccaatttaaaaagattgcaattccttgatttatcatataactatttaactgggataattccaaaaggtgtaggaaaacttcattccttggaacacttatatttggaatccaataatttaactggaagtataccttatagtataaatggtttgttttcacttcaggttttggatctatcacaaaataatctggaaggaccaatccctaaaagtattggcaattgcacttctatgagagttttttctgctcactccaataaaatttctgggactttgctcacatcattggccaattctacccagcttagacttctggatttaagaagaaatagattgatgggtgaacttccttcctaccttgcatattttcatgacttgaaaattttaactcttgctcataataatcttcatggtcctattcctcaatggattacaaatctcaagaagttgcatgtgttggatttatccaacaacagatttagtggaaaattaccatctcagcttgatagactctctggatttacaatcaatgaatctgctcccatggatggagtaactataactcaattcggaattgagtattttacaaatttttcagatgaaacactattttttgaggaaatggtatttgacataaaaggagttgaatataaactaccatatgtgttgcccataagcactatatttgatctgtctagcaattctcttaatggacaaattcccacaagcattggaggtatgagcagcttgcgactattgaatctatcaaggaatcaactggaagggttaatccctgcatctcttagtaacatctctgctttggagcagttagatttgtctaagaataatttaagtggagagattcctcaagagctctctcaattacatgagttgggtgtttttgatgtttcctctaacaacctctgtggcccaatcccaatagggacacaattttccacttttaatgttacttcatttcaaagaaataagtgcttgtatgggtgtcctttagatacatgcaatgaaaataaaagaccaaagagagaagaaaataacactactatgagtggtaagcatgtagtgggatggcttagtagagtggatgagaagatgtcattgatggctttggtaataggtctaggaattggatttggaggagtgatttttgtttttgtagtgtgggaaaaagctaggcattggcttttgtctcccaaaaggccacaaaccttttatggagtgtatcgattccctgaataatgggactttgtagatcagaaattgtatcagtaaaaaaaaaaaaaaaaa

SEQ ID NO: 839 - DNA, 3222 bp, Pinus radiata
catgagggagagagagaccaaggtctgtatcttcattttctgtattttcacatcatgggctctggtcgattttggggttcctgcagtttttgcagcacaagagactcagatacaaatactcctgaggatgaaagaggctctggaggatcccacaaatgcactcagggattgggatgggtctgaggattctccatgtagatggagagggattgattgtaacgatgaaggtgctgtgactcgcatacaactccatggaagttctctgagtggtcgcattctgcctgatatctgcaatctccagagcctgataatctttgagctagatcgaaattccctttatgggaatttccctccagaattttcgaattgcagtcggttggaacaattgaatttgagctccaatttgctgaacgggtcattgcccgacctttcaaaattgaaggctctgaaatatctggacctgtctaacaatcgattctcgggagagttccccgtttcggttgggaatttgacaaatcttgagtctctcagcctgggtattaatatgttcaatcggcgaacgattccagaggagctcatgcgactgaccagactcagttggctgtatctaacgaattgcaacttttatgggtccattccagcttctctgagcaatctttcggagctgggaaacctggagctctcgatgaatgacttgactggaagaattcccaaagagctcgggagcctcaagaagctgtatcagctggagcttttcagcaatttattgtcgggagagattcctccagagctcggaaatttgacatcattgagagattttgatgcttccagaaattctctgtgtgggagaattccggcagactttgggaagctggaaaggttacatttcatacaattatatcaaaatcagctctcaggggagataccagaaggatttggtgagttaaagaatttaatcggtatttctatgtaccaaaattatctcacagggcccctgcccccaaagctgggatctgtgtctgaattcaacatgattgatgtctcacagaacatgctcagcggcccgcttcccccagatttgtgcagtggaggcaagcttcagtatattcttgttcttgataacgaatttacaggccaaatccctgaatcgtatgggaactgtaagagtatgctgcggtttcgtgtgagtaagaataagctgacagggagaattcccaggggaatttgggagttcccacatgtttcgatcctggatctcagcttcaactcttttgaaggggagatcgctcctgcaattgggaatgcgaggaatttgtctgagctatatctgcagagaaatgggttctctggaaacttgcctgcagaaattgggcaagcttcgcagttgataaaaatcgatgttagcggtaacaagttaactggagctgtaccttccgagattgggaaattaagcttgttgaatagtctgtctttgcaggaaaataatctttcaggacccataccagctcagattggacactgtaagtttctgtcttccattaatcttgcatataatgagctcacgggacccattcctggcagccttggttttatggaagtccttaattctctgaatctttcccacaatatgctttctggagaaatacccaacaccttggccgctctgaagctcagttctgtggatttctctaggaattctttaacaggaccagtgccaattgagctcatcagccagaccaacaacagaagcttttctggaaaccctggcctctgtggtcaaggcctggaatctttgcagccctgtgatttacatacaagggatgtttatcaagagagatggataactgggtggattgttagtgggactgtatttacattcttgatcctcggcatgctcatcagaggatgcaggttgcatcgcagggattccaataaggtcaacaaccgaactttttgggagatgaaatccttccacaagctgaactttgatgagcatgaagttctggaatccatggacgaggagcacattattggtcatggtggctctggtacagtgtaccgaatacaattaagtaatggagagtctgttgctgtgaaaaaactctggacctgcaaaaatggccaccatggcggacagggcctgataaaccgagaattgaaggcagaagttgagacactgggaacgatccggcacaggaatattgtcaaactctactgctatttctcaaatggggattcaaatatgctggtgtacgagtacatgcccaatggaaatttgtgggaatccctgcacgtaggcaataggggagcgagtctggattggcccactcgttacaaaatagctctgggtgtggccaacggactggcttatctccatcacgactgccaaccaggtatcattcacagagatgtcaagtccacaaatatcttgctggatgcagaaaatcaggctcgtgttgcagattttggttttgctaagattcttcaagcctgccccagaggtgattcttcagttcgtattactggcacccatggctatatcgctccagagtacgcttattcatccagggtgaccgagaagagtgacatctacagcttcggtgtggttttactggagctcattacaggcaggcgcccagtggaagcagaattcggagagaacaaggacattgtatactggatttcacgtaagattttgacaagagaaggggcatttgaggttcttgattacagaatatatgaactctacaaggacgagatgattcaggccctcaagatcgctgttcgctgcaccagcaaactgccaaacgtgaggccatccatgagggaagttgtccagatgctcttggaggccaagccccggaatattgtcaagtcagtgcagggaaagaataataatgatgaaaagccagtttatactaaagaatcatccatcgtccacattcctgctgctgattgcaagccaaaatctgattccaaacctcaaagtaaagcataattaacttatctgaattcacccacctgcgagttctgtcaaaaatttctgtactgtgcagaagaaacaaaaaggaataaagaaaatcctgttgtacatagcagagtaccggagtctagacttgcagtccatatatgtatgtaggttaggttttgtttagggtttttctagggtttctgccaatgacgaggaactagggttttcctcgctcgctttatctacgtatt

SEQ ID NO: 840 - DNA, 2900 bp, Pinus radiata
cattccttctcttctcgtttgtgcaatgagaatgtttctattactcgtttatttgttcccccttgtcactcccttcgcgttttccacagtgcaattatctaatggctctaatgctgtcgatcaagaggctgtgcttggattcctgtctgcaatcactaatgatccctaccaatcgttacccactaactggaaatcaaatgtttcagtctgcgagtggacaattatcaaatgcaatgggtccagagtggtgtccctaaatgtgtcgagcatgggattagaaggtacaatctctcctcttctcggcaatctctcatttctggaaaaactcgaccttcgcaataacaattttcatggtcccattccctatcaattgggaagcctggtgcgcttgcagatgcttatcctcagtagcaataaactccaaggttccattcctcctactctgagtgggtgtcgcaatttaaggttcttgtatctgtctgctaacaatctcagaggtagcattccctcagaactctgtgttctctccaaattagcatactatattttaggacagaacaacttgtcgggtagaattcctacgtgcttgggaaatatgtcctctttgtataaaatatatctgggaagtaacaaccttcatgggcgccttccttccgaattgagtatgctgaaggttgtggaccacatcgatgtttggaataacagtcttacaggggaaattccttcttccttgtcaaactgcacaaatctccgaaatttgtctttgggtcggaaccaattaagtggacacattccagcggatttgtgttccaagcacacccgattgatcggactatatctgcatggtaattatttgagtggaagcattcctgcttccttgttcaattgtacgaagctgcacatcatcgaattgggggaaaatcagctcagcggggcagtgcccatggagttgggtaagttgacgcaacttcaagtgcttcacttaggcaataataaactaattagcggcagcaccacgagtttgccctttcttactgctctaagtaactgttccttactacgagtacttgatttatactctaataatctcacgggacgtttgtcgtcttctattgcccagttctctacaaaattggaggtcctgtacttggatcgcaataaactacatggagaaatacctccacaaattggaaacctaactggtttaacctaccttgggttagggatgaattgtttttcaggtgctatcccttccttgatcaggcttcaaaagttggaaaggttgtatctgtcggttaacgatttacagggaaatatccccactgaaatcggacacctcaaaaggatggggctcctacaactcgggctgaataatctctctggaagaatccccgagtctcttgctggcctacagcagcttagaaagttacgtctggcacataatcagttatcaggtaatatacctgccagtctagggaaattagtgactttggaggagcttgacttatcatacaacaggctcagtgggcgcatacctccggaggttgcaggtcttgtaaatttagctttctatttcaatctttctaacaatttattagagggtcctatgcctttggaactcagtaagatgactaaggttcaagctatagatatttcagcaaataaattaatgggtagcattccaagtgcactgggaagctgcacagcattaagctacctaaagctttcctacaacgcacttgaaggtctgataccagcttcaatcagtgagcttcaaaatcttcaggacatggatttctcctccaacaaattgtcagacttggacttcaaagctttgatatttccgttcatggaaaatggaagcttagaaaagtggttatatcccaatattgctgaagattcatgtgatttgagtttgattcagaggttgaatatagcaatagacattgcacatggtatggcatatctccatcatcattgttttgtccaagtaattcattgtgatctaaaacccaacaatgtacttcttggggacgatctcactgcatatattatagactttggaattgctaccatatgttttgcaaattctgaggaatcagcttctacttctacatatgcactcaaaggatcagtgggctacattcctccagaatatggacaaggtggacaggtcacaacaaaaggtgatgtttatagctatggaatagtgctaatagaaatgctcacaagaaagaaacccacccatagcctgtttgcagaaggaatggacttgagaaaatgggtaagtagctgttttccaaatcaactagagaaagtagtagataaaatcctattgaccagtgatagcacaaataacactgaagaggataagagggaaatgtgccttggtcaactcataagagtgggtttgctatgcacacaacaatcctctgaaatgcgacctaatatgatggatgttgtagagaaattagaaagcattcgagacacttttcttaaagctacccaaaactcaaattccaatcaaatatcatatcaaagattactgggcagttcaaataccagtggcaaccaggctggtacaagtgctcctagcaacagtgacagttcatcattctaatatataaatagttgtgtgacaatgttacaaacagtcaatgttcaccattctattgcaggcaacagtgaccgttcatcattctaatatattgtaaatagttgtgtgacaacggtaacaaacagtcaatgttcaccattctattgtattgtataccaaaagatggaatagtgtaaaccaattgaggaaacgatacccgtgtgactaaaacatgaaataatgtaaacttgttcattccttctaatatattatgtttcggaaaaaaaaaaaaaaaaaaaaaaaa

SEQ ID NO: 841 - DNA, 2149 bp, Pinus radiata
ggaagttggagtggtagagtgagaaatactgaaggaagttggagtgatagagtgagaaatggatcttcttcttctcctgcttgtgatgatgggtgtagcaatgcctactcattctcaacgttttccttttaatggacggagtatgatggggaaaccctctctcttcccatcctccatagccgggtatcatgaaaaaagggatgtggaggcacttctcagcttccggaagggcatcatatcagatccacatggatcgctctccgactggacggccaataactcacataacgtctgcctgtggaacggaatttcgtgcaggccaaacacgaatcgagtggtttcaatttctctcccttactgccggttgagtggtacgctctccccgtatattgggaacctctctcttttgcggtatttatatctttcaaataatgatttgagtgggagaattccagcagagtttgggaacctctctcttttgcggcaattagatctttccagtaatgatttgagtgggagaattccagcagagtttgggaacctctctcttttgcggcaatcagatctttccagtaatgatttgagtgggagaattccagcagattttgggaacctctctcttttgcggcaattagatctttccagtaatgatttgagtgggcgaattccagcagagtttgggaacctctctcttttgcggcaattagatctttcctacaatgctttcagtgggagaataccagctgatatcggcaactgcgctttgctgcaaatgtttcatattcaacgcaactatttgaggggttctatcccagcagaattcggccgtctggtccacttggaatctctctggttgtccatgaatgctctgagtggaagaatcacttctctgggcaactgcacttcacttacagatttggatattaacaacaacaatttgagtggtccaataccatcagaattcagtctcctggtcagcttggaaatactctggttcaatgacaatggtataagtggaagcattccagcttcaattggcaactgcacttcactctctgacttgatcggtagcggaaacaaattgagtggtccaatcccttcagttatgggtttgatgaaatgcatacataatattgatttatccaacaactctctcactggccacatccctcccacgctattcaattctactcacctatcttctttgaaactagcgactaacaaccttagaggtagcattaatccccccaatattagtaccaatacggaattgataattctcgacttatcaaacaaccagttaattggatctctccctcgtaacataggtcaattaagcaatcttcaacatctttatttatcaaataacaatttgactggatctctcccgcataacataggtcaattaaagaatttaagtgaactaaatctatataataataatatttctggcactatacccaatacaattaatttgacttcccttgagattttagatttatcaaagaacaatttagaaggatcaatccctgaacttaatggtagtagcctcttgataagttttttctctgttcacactaataaactttctgggactttgccaatgtttttggctaattgcactggaattgtgtatttagatttaagaaaaaacaatttgacagggcaacttcctcactatttgaaatctttttcatttttgtcaattttaaactttggctataataattttcatggtggcatccctgaatgggtaacaaatttcaccaatttgtatgtattggatttatccaataataaatttagtggaagaatgccattacattttgaaagacttcaaggatttgtaaattcttcaaactctgttttttcccttgatgaagaaatcacagttcacatgaaaggatgtgagtatactctgccatacctctcaccaacaaacacaatacttgatatgtccaacaataatcttgtaggacaaatccctgcaagcataggaactttgagagaaatgcgattgctaaatttatctggcaaccagttggaagggccaatccctgcaactcttggtaacatatctactttggagccgttaaactttaaccaaaaaaaattgaaaggggccaatcccgaaaaaaaaaaaaaaaaa

SEQ ID NO: 842 - DNA, 1175 bp, Pinus radiata
ggagaagctgctgctcatggctcccctgctgggaattctccttcttcatgctctcatttttagctatggagaagaagctcacgtcgctggttcgaaccacacagaggttcgggcactcatggctctcaaggccgggattgttgacacttcaggtcatctgagtgactgggaagtccatggcgatgaacttagtgcttcgccttgttcttggactggtgtgttttgtgatttggagtctgagaacgtgacggaactcgatctctcacggatgaatctcactgggacgatttcagacgagattcgggagctgcagcacctgaaagtactgaatattagcttcaatcagttttccggggcctttccagttgtaatctttaatctcaccaggctgcggagcctggacataaatcacaactctttcgaagggtatttcccggccgggatctcgaagatgaagaatctagtgaattttatagcttttagcaatagtttcaaagggcctctgccgctggaattcgtggagatggcttttctggagcagctgaatcttggtggaagctattttaatggctccatacctgagcaatatgggatgttcaagaacttaaagtatttgcacttggctgggaattctttaaccggaaaaattccaccggagctcgggaggctccacggtctccggcatcttgaaattggatacaatttctacgagggcgggattccatggcagctcagcaacatgacagagcttgagtatttggatattgcgcaagctaatttgtctggggctttgccttgggaattgggtatgctgaggaagctgaatgctttgttcttgttcaagaataatctcagcggcacactcccgcctcagctcagcaacctccgcagcgtcctgtctttagacttgtccaacaacacgatctcgggttcgattcccctggggttctctaggcttaagaatttgaaacttctgagccttatgtataataatctgagcggcagcatgcctcaggggatcggcaatttgcccaacctggagattgtccagctttggaataattctttgagcggaattctgcctccgaatctcggcagaaaccgaaagctcaagcagcttgatgtttcctcgaatcaattcacgggacccatcccgccggatctctgctcgtgcc

SEQ ID NO: 843 - DNA, 1052 bp, Pinus radiata
gctgctcggcactctcagacgaagttacgaaccatgaggtccgtgtttcgaatctcgtcccttctcgtgatttctattctggttctgctcacgctttcttccgccattaacgacgatgcagagacgccgcgcgcgcaaaacacacacatagcagacccacaccgcccccgccccggggacacagacccacacccccaaaatctctggggggacacgagacccctgcaaaaaaaacaaaacaaaaagagcgcgcgacacgacaaaaacaaaaatctcgcgcatcattccgccccggacattatcgagcctcgacagtctcgtgaatctcagcttggcgctcaacaaattcagcacgccgttcccgtcggcgtcctcgacatttccactctgcgattcctcaatatatccaacaataacttcagcggcgagatcccggcaaacatttctcggttagtgaatctggagttgctggacacctacaacaacaatttttccgccccactgcctctggaagttgcgtcgctagccagactccggtaccttcacctcggcggaaattatttctacggttcgattcctgctggctacggcaacctgacgagtctccactacctgggcctcaacggaaatggcctcaccggtaacttgccgccggagctcggcaaactcgccgagctacgatacctcttcatcggccactacaacaattattcctgcgagatcccgcctcagtttgggaacttaaagaagctcatccgactggacatgtctaactgcgggctcatgggttcgattcccgcggagctaggcaatctgagctcgctcgactcgctcttcctcttcttgaacgtcctgtcgggccccattcctccacagctcggcaatctgagaaacctcaagtcgttggatctttcattcaatgatctgactggacaaatcccggaagaattcaagaacctggtctcgctcacgctcctgaatctggtccataacaggctccatggcggaatacccgattccatcggcgacctgccggacctcgaggtgctgaa

SEQ ID NO: 844 - DNA, 3776 bp, Pinus radiata
caaaccctctgaaatatttttgtaattccttcattttatcgatcgcccatctgaggagccgatggcaccttccacagatttcatcctcatcacctccacactcatgctcatctttgtttctgcaaacgcccatcttcttcatcattatcatgagaaaagtcgtgaacgactgcaggtcgatatagaagccctgcaagcattcaaggcctccctcacatatgatccttctcacgccttggccaactgggattttgtcgccaatcatgtctgcaattggactggtgtcacctgcaaccctcacaaactgcgcgtatctgccctaaatctctacaacatgagcctgcaagggactatacctccacatttgggcaatatctcctttcttggcgtgttgaacctcactttgaacagtttctctggcataatcccaaacgaattgggcaagctgcgtcggttaaaacgtctgtccctcaagcagaatcagttgatttcgtccattccagaggctttgaaagattgcacatctcttaggctgcttaacctgtcccacaataatttaacagggactattcccagtggtctcggccaattgcaaaacctgcaaaatctttcactgtcctttaatggattgactgggaaagtgcctgaaacctttgggaattgttctgcgctggagattctgggtctaggaagtaacttccttagcgggactatcccttctcatcttggcatgcttgctagaattaaaattctgtctcttggacgaaaccagctcagtggaggaatcccgccttcactgcttaattgcacggagttacgcggattatatttgtatgagaacaggcttactggagaaatcccgtgggagataggagccaagctctctaaaattgaaactctgtctcttggaggaaaccagctcagtggaggaatcccgccttcactgcttaattgcacggagttaagcgaattagatttgtatgagaacaggcttactggagaaatcccgtgggagataggagccaagctctctaaaattgaaactctgtctcttggaggaaaccagctcagtggaggaatcccgccttcactgcttaattgcacggagttaagcgaattagatttgtatgagaacaggcttactggagaaatcccgtgggagataggagccaagctctctaaaattgagactctgtctcttggaggaaaccagctcagcggaggaatcccgccttcactgcttaattgcacggagttaagcgaactagagctcgatgaaaacagcctaacgggaggcatacctcaggaaattggaaagctccgcattctacaggatatggatcttgataataatcatttgtatagtgaggaatccatttccttctttggagcactttcaaactgcaccaatctgcaaatgctctctctttcgagcaatgatcttaagggcgacttgcctggaagcatagaccgtctttctcaaaatctgctttatctctatttgggtgggaatcgtttcactggtaagataccccaggagatgagcaacctcactggattgatcctgttagatctaaacgacaatttgctctctggaggccttccctctgcacttggaaggctctctgcccttcaagcgctggacctctcccggaataacttggaaggtaatataccctgtcaattcagtcaattgaaacgtctgtatgcactggaactttatcaaaatgcgttttctggagaaattcatcaagtttttgcaagtttgcagcagctaagaagattagatctcagctataacaagttcagtggtaatataccggataatgatatagggaattgttccaatctcgagcttctggacctcagttacaaccagctaagcggcttgatgtcttggaaagtggctagcctccataacctacagttctacattaatgtttcacataatgcgctcacaggaagggtgcctgccgaactgggaggaatgcacatggttcaagcaattgatctctcagccaataatttttcggggagcatacccggccaattggtgaattgtgctgaactggactaccttaatctttctcacaattcattggaaggcactattccgacatcaatcgatcaagttgcaggacttcaagatttggatctctctttcaataagctttccggtcccctgcctacctctatagagaaattacagaagcttacgcatttgaacttgtcatacaataacttcacaggagaagtaccatcctctggagctttcagaaaactgaatttgacatcattcttaggaaacagtggactctgtggcagatggatagagttacctcattgtaaattgacgacaaggcaccatcatgattccaaaagaagggtagttatcttggccacttcggtcggtttaactttgctattggtattttgcctagccttaatcatggttttgatatattttcgtagcaaaaagtctgcattgttggaaactatttcagctagattagggaggatgctgaggagccaactccgcgagacgaagattgtaagtgaggaagaggtgaacagagcaactaatggttttagcccggataacctactggggcgtggcggccatgggtcagtgtataagggcgtattagagaatggcacagtcgttgctgtcaaagttatacagtctgccacatcaggaggtgcatacaagagactcataaaagaatgcaagacgttgggcagaatccgacatcggaatctggtgagaatggtgggcgtatgctcaagtttgcatgtcaaatctgtgattatggagttcatgtcgcagggaaacctggataagcatttgcattgtagggaaaattcttgcaggttggatctgaaaagacggcttagcattctcaaggacgtggcccatggaatggcataccttcatcattactgttctccagccattgttcattgtgatctgaaaccttccaacgttttactggatgagacgatgacggctcatgttggagatttcggtatttcacgcctcatcaacgattcagcagcagcagcagcctcaggggacacctccagtcatgtgatcgggtctgttggttacattgcaccagaatatggtacaggagggcgcccgtccatgaaaggggacgtatacagctacggcatcttggtactggaaatgataacgggaaagaagcccacagatgcagtgttatcagaagaagagcagtcattgcagagttgggtgggcgatgcattccccgacagattgttggaggtgattgacaggactttggtggaggagattagaatggaagaagaggatgaagaacctgaatcacatgatgtaagtgaatttatagggcatggaattgttgtgctgttggcaaagataggtgtcatgtgcagcaaaggggatcctcatgaccgaccgacttttcgagaggttgaggcatcgctagagcagctggtagccaaaatccataagaattcagaaaatgagttgaaccgccttggacaggtaacggacgaagccatttctgaatctgattagggcttgttgtggaagaaaatgatcagtggttagcacatatatttggaggaaaatgattagtttagattagatgaatagttctgcatttttgttggtggtaagtgtgattatattttcattggtggtaagtgtgattataggttttttttagaagtagttaaatccaacgatattttttagttaattaatctcttatattaaaaaaaaaaaaaaa

SEQ ID NO: 845 - DNA, 1096 bp, Pinus radiata
atggcttctctgataggaatagtaccgttgctgctccttctgacgctaattcctgcgaccgagagcttcaatgatacagaggcattactccaatttagagccctaacggattcccatggcattcttgccaaaaactggagctcggccgatgcctgcactgggaaatggcagggcataacctgcaaaaacggcagagtcttcttcgtttcgctttcgcgccatgagttacgaggccctatcgatcctctttctgcgctcgaccagctccgggttcttgatcttcagggaaatcggctcaacggcagcttggatccattgtcaaattgctacaatctcaaattgctctacttggcttccaatgacttctcgggtctgattcctgctgatcttgctcggctcaggcgcctggtgaggctcgacgcttccgataacaatctccgcggatcgattccgccggtgatacggaaccttacgcggctagtaactctgcgcctgcagaacaacattctgtcagggccgttgccggatctcagcttcttgggggacttaaatgtttccaataatgaactttctggccaagtaccccgccaacttctggagaagttcccggcttcggccttcgccggcaatgctgggctctgcggacggagtccttttccggcctgtaccattccgccaccggtggctgtagtggtgccgtcgaatccgagctccgacccgggatcgagtactcccgtggacacgagatccaaaaccagggctctcagcacgggggccgtcattgcaattgtggtcggggatgctgccgttctgattttgataacgctaatttttctggtgtattactggaagaaatacgtcagggaggccgaggttgctggaaaaacggcctccgagaagatggatttctccggtggcgcgcagacgccagagatggagaagagtaaacttgtgttcttcgataggaagaagcagtttgagttggaggatctgctgagggcgtctgccgagatgttggggaaagggagctttgggactgcttataaagccgttcttgatgatggctgtgttgttgctgtcaagagattaaaggacg

SEQ ID NO: 846 - DNA, 1160 bp, Pinus radiata
tctaagctgttctggtgcttggccgcattattgtgtggcatttgctgctgccattcgttttcccctgctccctcgcctgtggactttcaggagataagcggtattcagcaatgcaaccagagtgatgtgcaggcattgatcagtttcaagcaaactgttagcagttcgagccctctgaattgggaggtcaacaggagttgctgcacttgggagggcgtgacgtgtggattattatctctgcagcagtttagcgtcacaaagctccggttgccaggaagaaggctcaggggaactctttccgactcattaggtcgattggctcacctcagagagatcaatgtttcattcaatttgcttactggtgaagttccaggtaggctatttcttttacagcatctggaagtattggatttaagtttcaataatctctccgttattgctccagttgcacaagggcttaattctattcgtactttcaacatttcaagcaatagttttcgaggaaatgtcccccaacttggctccgctgtaaacctcacatcctttaatgtcagcaacaactcctttactggccccattccagtacatatttgtcagaattctagttctcttcagtatgtagatttttcactgaatagattcaatggcactcttaaggaaggcctggggcaatgtaggaagctccaagcattgaatgcaggattcaactctctggctgggccaattccaaatgatctctatggcatgtcatctttgaggcagctgcgtctgccttttaaccaatttacgggaacacttcgtgcagaaatagggaacttgtccaatctttctgttctgtccctttctgctaacagattgacgggacttattcctctggagcttggaaagcttgaaaatttggaggggttaattcttcacagtaatagattcactggtatggtaccttctcgtctgtcccaatgcaagaagttgaaaattctgaatttgaagaacaactctctcacgggagttattgaactgaattttacaagcctgcctgagctaatttatctggatttagctagcaacaatttgtctggcagtattccgcggcacgagagtacttctagagcggccgcgggcccatcgattttccacccgggtggggtaccaggtaagtg

SEQ ID NO: 847 - DNA, 654 bp, Pinus radiata
atgcgaccagattctgtaccgtccgatcaggcggaacagcgggtggaggggaaagccgcctttttgcactgcaattcaagcacgacacacgaagctgtctctgaaatttcggcccccttcgatggactttctttcctttccgtgaacctcgtgcccgagtccatctcttggccttgcaaaagatcgcctgcgctgtagccttcggcatgaatgtaaacggaaaatttttgcaggatagtcctcattccggtcagcgcttgggaagaaagataacgatgagaggacattgagaatcatatctacaaacaatgaagtgtcttgtagtgctcgtgcttttgtcaattgtatggtcaactggtgcatcaaatgctgaaggtgaggcattaaatgcattcaaacagtcgttgaatgataccaataattcacttagtgattggaatgttgatttagtggatccatgcagcagctggtcccatgtcagttgtgttaatggtcatgttgcgactgtcactttgaccaacatgagcttttcagggaccatatcacctcagattggccagctgacattcctgacttacctgactttagaaggtaattcattgacaggaagcataccacctgaacttgggaacatgactagtctacagaacctac

SEQ ID NO: 848 - DNA, 2084 bp, Eucalyptus grandis
gtccttttcgttcggtataagctggtccggaggctttgcataaaaagctttctggcctaccgtcgtcatcaatgaagcgctcgtcggatctcacgatcttgttttgggttgcatggcttgttacggcagtcgctgcggtggaggacgatatccagtgcctgcagggcctcaaggcctcgcttggcgacccacaagggaagctgagttcttggaggttcgcgagctcgtcggtcgggttcatatgcaagttcgtgggcgtttcttgctggaacgaccgagagaaccgcatactcagcctcgagctccggggcatggacttcacagggcagattccggagtcgctgcagtattgccggagcttgcagaccttggatctctccaacaatggcctctctggtacaatccctcctcaaatatgcaggtggcttccttacttggtgactcttgatctgtcgagcaatggcctttcgggctctataccacccgacctagtgaactgcacttacttgaacaatcttgtgctgtcgaataatcgcctgaccggcactataccatatgattttttgactctgagtaggctcaagaagttctcggtcgcgaacaatgatctgaaagggacgatcccttcgttctttaaggggtttgataaagcaagttttgaagggaacgatctctgtggagggcctttagggaagtgtggtaggttgagcaagaagaacctgacgatcatcattgctgccgggatttttggtgccgctgcatctctgttgcttggtcttggcctatggtggtggtatcatctgagggttgtgaggaggaggaggaggagaatgtatgggattgggagagatgatgatagtgtttgggctgagaggcttagggctcataagcttgtccaggtttctctgttccagaagccgattgtgaaggtcaaattggccgatctaatggccagcacgaataatttcagcacggataatataattatatccactaggactggatgcacttataaggctgtactactagatggatccgcactggcgattaagcggctcaatacttgtaagctcggggaaaagcagttcaggttggagatgaaccggttgggacaactgaggcacccgaatttgacgccccttttggggttttgtatagtggaggaagagaagctgttggtttacaagcacatgtcgaacagcactctttactctttgctgcacggaagcactgttttattggattggccaactaggttccggattggtttaggcatcgctagaggcctcgcttggcttcatcacgggtgtgatccgcccttcttgcatcaaaacttgtgctccaacacgatcttcatcgacgaagactttgaggctcgaatagttgatttcggcttagcgaggctcatgactacctcagagtccagtgggagcagtttcgtgaatggtgatttgggggagtttggttacattgctccagaatacccgagcaccatggttgcttcgatgaagggggatgtttatgcatttggtgtgctgcttttggagttggtaactgggcaaaagcctctcctggtgaacaaccctaatgaagaattcaagggtaatctagtggattgggtgaatgtgctctctagcaccgaccgaattaaggatgctgttgaccaaactctctgggaacacggctatgatggtgaaattctgcagttccttaaaattgcttgcagttgcataaattctcgacccaaggaccgatggtccatctaccaggcttaccagtcattgaagagtatggccgaagagcagggtatgacggagcaatatgatgagtttcctctcattttcttgaagcaggataacgagtggatgtagctaaagaggaaagagtcaaagcttgatccaattttcaggcttcagttcccatggaaattcctaagtatttggtgaaacttcaaaaacattcctcatgtaaagttggcgcaatctgcatcttcagcagcatatgtaatttttctagacgatgaaataagctatttagctcttggttcttgcatttttcaggagcatatgaaaaaaaaaaaaaaa

SEQ ID NO: 849 - DNA, 1800 bp, Pinus radiata
cctttgaggaaaacggtgtggaggggatttctacgtttgaccaatcgacgcggtgatgtcagtttcgtctggtgtggcgagaatgggaggcaaagcttgtgaaggtgtgtttgaggaagcaggggcgttcgctggttgcgaaactcacgtgttggctgttgatgattgtgttatcgacaggaagataatcgagcggctgctggagacagatactgtgaaagttaccacggtagacagccccacgagagcgctggagatgctgggattaacccaagagccgacgacgacaccaccttgcaaaaatgcgttcaagttcagcatgatcatcaccgattactgtatgccggaaatgacaggctacgatcttcttaagaaactcaaggaaacgaaggggttgaaagaaataccagtggtgataatatcgtctgaaaatgtaccacagatcattcaaaggtatagatttctgatacagagaaataactcatggaataatcgccttagagagtggttaatttaaccttagagcctcgtaaaaattatacccattctgcacttactggcacataaagactacacttgtgcatagaagccgtcgtgtcctgtgtggttccacacagtaatatccatcttttgacatcgtaaatcttgagccatacatcttaaagttttataatgcagggcatttttatatcaagtactctacattcggtgcatccacttcaggttcatatctacatagtgatatccaggtttgaaatcttaaattttgactaaagttttaaagttttataatgtgagacatttttatattagttgtagattgagtgcatttataaagatatagagtaaaattaaatttttatttttatttttattttttattttaatctaattgattagcaaaaacataaaactataattttagttttaaataccaaaatttacataaattaactcaatgcattatacacttctatgtagatgacattgatcagccatccataatacacttctatgtagatgacattgatcagccatccatagcataaattaactcaatgcattatacacttctatgtagattacattgatcaacccatccatagcaatgttgtaaatatagcttcatgtcagaaggattgttatcgatatagataccctctctcaaataagaattttggcacaacatcagtgtagtataagtgtggccaaataacataaatgccttgttatctatgaggaaaagggatataagataggtgaaattatttgttcatagtttataagtatatatatttttttcttttcttggttttggattattaatcaatttgttacattttaagaaaacaaattcttttctggcacttaaataaattgatcatgaataataaattttaaattattttcctggttactaggtgcaagccccggaagtgatgattgatgttatgtgattcgttctccacattttactagtttcaatcccacttcttcacccctgtgagcatcacccgatgcaatgagtgctaagtgaactattcaaaaatcatgagaaattagtcagttacgactacctctcatggaaatggttatacgtgaatgacttaacgcagttgaatcccaaaataatatctaatataatgcactgcgtaaacctcatacttaacatttaaaatattaattgaacattttttagttctttattacctattaaattaaatataacaatagtataattttttaataaatccttattcactttagcattttaatattattaaaaaaaaaaaaaaaaaa

SEQ ID NO: 850 - DNA, 840 bp, Eucalyptus grandis
gacagacttctgtatgcccgggatgagcggctatgatttgctgagacgagtcaagggatcttactggaaagatgtgccggttgtggtcatgtcatcagagaatgtgccttcaagaatcaacatgtgagttgctttctgctgcgaaaaagcaaaagtcgcaccgctttatacctcttttaaccttaggtcaattaaaagaatgcttctttagcatagtcgatactttacagttatgtcaaatatcttgccgatcacaggtgcttggaaggaggagccgatgagttcctgttgaaaccagtccagctgtcagatctagagaagcttcagccatacattctgaagtctctcaataacccttgtgaagacatcaaaggtgacggcatagacgacagtgaagatgatgagatcgagacgagaaattacggagaggacaacaccaataagtgcaactctaataccaataatgttgccaagaggaaggcaatgtctgctgagccaaccgatagaagacccaaaatcaaaggattggcaggggtatataataagaatcaagaactaatcggctgatcgaaagtgcgccatgtgtcctcgccgagatgtttgccagttgggaactccactagactaatagcatcacatgtccttacttgtccattacatatgttccttttattggttactgtgttcttgagaggaaagaaaaggaaggaaaagttcagttttaaaagtctccgcaatggaaagcctgatgtttctgatcagaaagagattattattttggtgttttccctactattttcattttgtcgtttagattttaccaattggtaattaactccc

SEQ ID NO: 851 - DNA, 1633 bp, Eucalyptus grandis
tgattccaacatgactagtaacgaagcttctgaaaatgtcacggtaatggtcagtgttgaagataccggcatcggcattccattgcgggcccaggatcgtgtatttatgcccttcatgcaggcagatagctcaacttctagaacttatggtggaactgggattggcttgagtattagcaagtgtctggttgagctgatgggtggacacataaacttcataagccggcctcagattgggagcacattctcctttacggctgtgtttggaagatgcaaaaggcttgtgtttgctaatgtgaaaaggacttttgaagatcttccttctggttttaaaggattgaaagcaatagtggttgatggtaagccagtcagagctgccgtaactagataccatttgaatagacttggcattaacgttgaagttgcaagtagcatcaatgctataacagctacgggcgggaaaaatggttctctgactgctggatatcggcacccagacataattctagttgagaaagatatgtggatgtccagcattgacagctggataagtttaacggtggcagactggaaacagaatggcaatttaattcagcttccgaaaatcctcctcgcaagcaaaatcagtgcttctgaactagagaaggcgaaagcttctggttttgccgatactgtcattatgaaaccagtgagagcaagcatgcttgctgcatgtctgcaacaggttctgggcatcggaaggaagaagcaattgcagaaggatatgaacatgcgaaatggatctagcgccctgcggagccttctctatggcaagaagatattggtggtcgatgacaacaaggttaatcgaagagttgcagcaggcgcactcaagaaatttggggccaatgtagagtgtgcagagagtggaaaagctgcattagagttgcttcaactgccacatgactttgatgcttgtttcatggatatccaaatgcctgaaatggatggatttgaggcaacacgacagattaggctgatggagagccaggtgaacgagcaaatgaaaagtgaatctgcagttcaaatcgtaaaagggggtgagtggcacatgccaatattggcaatgacggcagacgtgattcacgcgacttatgacgaatgccttaaatgcgggatggacgggtacgtctcaaagccctttgacgaagagaatctttaccaggcggttgccaaattctttaggaccaaacccgtctaggacttgaaaacttccaagtgtctggtgaattcatggatgtcacaactcagatgttgcagtgaaaaaaagtgaccagcgattttgtattctgctggttggtttttcatgtcgataatggccccactcaaaaatgccggcactggtaaattgttcttacctgactcaaatcattattttaactagagtagaatgaatcggagtatttgtatactaccatagaacatccagccctgcttgtctgtatagatcttaaaggaggggcgaggagtccaaaaggtgtatattttcatcgtcgtaaaatcttgtatgcttttttctcagaaatctctgaaccacttaatacaatctggaaatgctcttttctagctttccttcattaaaaaaaaaaaaaaa

SEQ ID NO: 852 - DNA, 917 bp, Eucalyptus grandis
gtttattctgcccaccctaagatctgccaattcaaaaccacaagctcattggtcaccatccgcaactccagtcttcgagcaggcagggaacaacaggcatggaggtgggtcagatgcagaggaggttggtagagttcaccaaatcattgttcatggaggaagggtttcttggacgggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaaagccaagcccaaggtcaacaagtgaaaggcaacaaccccaacaaaagggcaaaaaaaagtaaaaaagcccggcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctatatttgggatttaattctgtactttcttaagctgatgggcagtggaggtggccttattacaccacagattttggtgttcaaaagaagagcacaagatcttcctaatgcagaacataacattagagaaaaaaaaaaaaaaaaa

SEQ ID NO: 853 - DNA, 1813 bp, Eucalyptus grandis
gctgtgcgggttcctctgctgcatctctctaatttccagataaatgactggcctgagctttcaacgaaacggtatgctttaatggtgttgatgcttccatccgacagtgctaggcagtggcatgtccatgaactggagctcgttgaagtggtagctgatcaggttgcagttgctctctcccatgctgcaatactagaagagtctatgcgggcaagggatcttctcatggagcaaaatgttgcacttgatctggccagaagagaagcggaaacagctattcgtgctcgcaacgattttttggctgttatgaaccatgaaatgagaactcccatgcatgcaattattgccctttcttccttactgcaggaaactgaactgacccctgagcagcgtctaatggttgaaacgataatgaagagcagtaatcttttggctactttgataaatgatgtactagatctttcgaggcttgaagatggaagctttcaacttaacatcgccacgtttaatcttcatgctgtgtttagagaggtccttaatttgattaaaccggtggcatctgtgaagaaactgctcatcacattgaatttagccccagatttgcctgagtatgctgttggggatgaaaaacgcctcatgcaagtcattttaaatgttgttggtaatgcagttaaattttctaaagaaggtggcatttcgataaccgcctttgtggctaaagcagagtatctaagagaagccagacctcccgaatttattccagtgccaagtgataatcacttctatttacgtgtacaggtgagagattctggatcaggtattaaccctcaagatattcccaagttattcacaaaatttgcacataaccaatcattagcaaccagaaattctggtgggagtggactaggtcttgcaatttgtaaaaggtttgtaactctcatggatggacacatatggattgaaagcgaaggcattggcaaaggatgtactgccacgtttattgtagggctgggaatcccagagaagttgaatgaatctaagttccctgtattacccagagggtcatcaaatcatgtcctggccaatttttctgggctcaaagtgcttgttatggatgacaatggtgttggcagggcagcgaccaagggacttctcctacatctgggatgtgatgtgacaaccgtaagctcgggggatgagttgttgcatgctgtctctcaggaacacaaggtagttcttatggatatttgcacgcctggtatagacagttacgaagttgctgtccagatacacaggttgtattcacaacatcatgagaggccactcttagtggctatcactggaagcactgacaaggtaaccaaagagaattgcatgagggttgggatggatggtgttatccagaaacctgtgtcgcttgataaaatgagaaacgtactgtctgagctactggaatgtggacatcaaatgtctagtttggcccgtgtttgagaagaacggagaaaataagactgcgataaagtttcttgcggcaaatgatttgtaaatactgcatgcagtggaacattggagggttatcaagcaatgctacaacaaccccatgtaatacgagactcataccgatcatttttatccaagaatgaccaaggtcatcagatgattgaacaagccggagcaccatagtggagctgctagtaacttcacgggatgatgacaagtcttatgtgtcgtcgacaaagttgtgatgtcgttgcaattgtaagatattatggtcccatcaatgatatctctttgtttgaaaaaaaaaaaaaaa

SEQ ID NO: 854 - DNA, 745 bp, Eucalyptus grandis
gccaattcaaaaccacaagctcattggtcaccatccgcaactccagtcttcgagcaggcagggaacaacaggcatggaggtgggtcagatgcagaggaggttggtagagttcaccaaatcattgttcatggagggtttcttggacggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctat

SEQ ID NO: 855 - DNA, 925 bp, Eucalyptus grandis
agaagatgttagttaagtgggcagagcatttcccacattataaagcaagtcaattttgtatttatttttttaagaccacatcaagccactgaaaatcactttcagaggttcttctttagcatttatagcttctctgatctgatctgatctagcggtttattctgcccacccctaagatctgccaattcaaaaccacaagctcattggtcaccatccgcaactccagtcttcgagcaggcagggaacaacaggcatggaggtgggtcagatgcagaggaggttggtagagttcaccaaatcattgttcatggaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctatatttgggatttaattctgtactttcttaagctgatgggcagtggaggtggccttattacaccacagattttggtgttcaaaaaaaaaaaaaaa

SEQ ID NO: 856 - DNA, 3536 bp, Eucalyptus grandis
ggcacgagattttcgatgcatttgattattcttgaactgggcacgtttcagatctaaggtgcaaggctttttcgctgattccaacctcaattctcacttgggaggcggtttctttggcggaaggctcaaactccattgcggaaaggtcaattgacccttctttgccccttaccctggttttaaatttattcaacaatattgctcatcattgacctagttaaatgtaaaagctgcattgaactggatgcatagactgaagcaaggtattcaagctcaaatgtcggtgacattttgaactcacacgtgaagagccatgatggtgtgtgagatggaaaaagatcctattgaagatatggacatcgaagctctgccttcgatgtggcctgaagatattgataatgatgctggaaagcagttcaacatcgaaaatcctggaggagatgaagatatgttgaaggaggtcacgattccagaggagccgaacatagttgatattaagcggcttttagagctaaccaactatacagaccagggtgcttctcagttggcgtaccttgtaaagcactgggagtacaggcaggccaatgcagtacgccttctaaaagaggaacttgacatcctgagcagacagaggcaggaggttgagctgaagaaattggagatacttgaggagcatcgttttgagggagaacgatatggtggtgacaagcgcccaatatctatactcgatgatgccttcgatatttggcaagatgttcctcgaaggaaaagtgatgtagttatccaaaataagagggttgagattgatgctgagtacgatactgtcatttactggaagcagcgcgccatgcacttagagaaattgttggaggcaagtatccacagagagcaggcgctcatggaaaaattgcaggaaagcataaacaatctggaaaagcagtcctctcctgtggaagagctgtctcagatcctaaaaagagctgacaactttttgcattttatacttcagaatgcacctgttgtgattggacaccaggacaaggagctgcgatatcgcttcatctacaatccttatcctactttgaatgaggaggacgttatagggaaaacagacatcgatatcttcactggtgctggtgtgaaggagtctcaagaatttaagagggaagtgctggagaaaggtttacctgcaaagagagaaatcacattcgatacagaattatttggtgcaaagacgtttctgatacacgtcgcacctgtctttagcaagactggggaaacaattggaattaactacatgggaatggatgtcactgatcaggtaagaataagagagaaaatggcaaaacttcgagaagagatggcggtacggaatgccaaggaaaccgagatgaataaaaccatgtatataacagaggagacgatgcgagcgaaacaaatgctagcaacaatgtcacatgagataaggtctccccttgctggggttgttagcatggccgagattcttgcacaaactagacttgatcatgagcagcggcaattgttagatgtcatgctttcttcgggagatttggtccttcaactaataaatgacattcttgacctttcgaaggttgagtcaggggtaatgaagctggaagctacaaaattccggccgagggaggtagtaaagcacgtgctgcagactgctgcggcatcattacggaagatattaacattggaaggacatgtagcagatgatgttcctattgaggtcatcggagatgttctaagaattagacaaattctcaccaacttgatcagcaatgccatcaaatttacacatgaagggaaggttggcataaatctatatgtggttccagaaccatctgtcgagaaaacagaagaatgtcctcagaagtcacaagcagatcagtcaaccccacgggagaacagggggaaggaagagaaaagctctttagtgtgtcaagcaagttgtgaccaacaacctgttcaagtgaagagccagaatggccatttatgccaaaatcatgctctgcatgataatactcgaatcatgtgtgaaagcgaagaatctgcagatagagataaggtggaagagcacacccccgagacaacagtatggatctgctgtgatgtgtatgacacaggaattggaatcccagagaatgctttgcctactttatttaaaaagtacatgcaagtcagtgctgatcatgctcgaaagtatggtgggacgggacttggcctagccatatgcaaacaactggttgagttaatgggaggccgtctcactgtgtctagtcgggagcatgttggatctacattcacatttgtgctaccttacaaggtctcaccaatatgtgataactccgatgattccgacgatcttgcaattatggctaatcatgattctgcagttgacgacatcaccgatggctttttccaattccagccacccactctgggttctctcttctcctcaaatggttccagcaggacacagaaactatcatcacataatgttggatacactagtataaataatctcaatcgggttgcagaggattcttatgcatttccaactaacaacctccgacttaaagagttagcttcacctgaggatgcctgttctgcagttgatgctgctgagacctcgtcagaaacagcatgctcagtaagtcccagtgtacattatgagtgcaaggttgatgtgaagaacggcaaagtgaatcaactgggtacagaatgtagatcacaaatttcaagttcaaatgtgtcttgtcttgaagtggaaaaaggacaagtagataagcttaccataagtgaactcccaaggtcatgtcccgagttggagaaatcttgtgcaagttcagagagcacgtccagcagcattgtggaagaaccaaaacccaaaccaaagcctaagatccttctggtggaagataataagatcaatgtcatggtgacccaatccatgatgaagcaactaggtcatagtatggatgttgtgaacaatggagtcgaagctgtgcatgctgttcagcaaagtacttatgatctcattctgatggatgtctgcatgcctgtcatgaatggccttcaagcaaccagaataatccgatcctttgaggagatgggaaactgggatgctgcagtaaatgctgggatagagctagtctcttcagacttatcatgcaatggtcacagttctagagaatcaaaagaacgagttcccattattgcgatgacagcgaatgcattgtcagagagcgcagatgagtgttttgcaaatggtatggactcatttgtgtcaaaacctgtcacttttcagaaactaaaacagtgtctcgagcagtacttgatgtaattcccctgtatagtatccctctgaatgtatgactcacatgtaggaaagttttgtaatcaatgtaaattattcctcggccaattgtagagtagaatcattcctttctttttttttttcccattccaagaaagatggacaagggaacacatagaaaaaaaaaaaaaaa

SEQ ID NO: 857 - DNA, 2578 bp, Eucalyptus grandis
ggcaaactaaaccacttctctcctctctctcacatcctcctcctcctcctcctcctcctttcttcctctgaatctcatctcattcagatcttacattggtcccgaatgggcatggcagcagcagagtcgcggtttcatgttttagctgtggatgacaacatcatagacaggaagctgattgagaggctccttaagacctcctcatatcaagttactacagttgattccggtagcaaagctctagaatttctgggcttgcacgaggatgatcgaagcaactccgtttcgccatccatttcgacaaacaatcatcatcaggaattggaagtgaatctcatcataacggactactgcatgcctggaatgacgggctacgacttgctcaagaaaatcaaggaatcatcgtctctgagagacatcccagtggtcatcatgtcatctgaaaatgtccctgcaaggatcagcagatgcttagaagaaggagcagaagaatttttcttgaagccagtgaggaaatcagatctgaacaggctcagaccccatgtgatgaaagccgtatctaaggatcagaaacaagagaaacacgaagaagaagaagaagaaaaacaggaagaaaaagagattaagtcgcaaaagcatcaagaacagcaacagcaacaacatcaacaacaattatcgccgagaccatcaggcaatagcaagagaaaggccatggaagagaatctttcgcccgatagaacaaggcccagatacagtgacattgctgctgtcgtctgatcaagccctccccaggaatttctttctttttttccccaacaaaaaccgtatatatagaagaagggctttcaatgctggatcatacacacacacacggttaaacagaagatggagagacagttcctttcgtgtacacacattctgcatggagataaaagaggttcctgcccaattttgcttttgaccatatggaggatggatcatcactcatcagaaaagagaggaaaacataagacagagagcgagagagcgagagagcaaaagagaacaaagagatgagatgagatgagatgagatagtgtactctgaaagaagtttgactgatagcttgtagaaaggattagaatcacctcgtgccgaattcggcacgagtcgcctcgcgggctacaaataccgccatccatcaccgtcttctcctcacatccagaagaaggaatcatctttttcatcgctcaagaaaagaagccgaggagtttggacaaccatgtcgaccactgtcgggaaagtcattcgttgcaaagctgcggtggcatgggaagccggaaagccactggtgatagaagaagtggaggtggctccaccgcaggccatggaggttcgagtgaaaatcgttgtcacagcactctgccacacagatgtatacttttgggaagccaagggacaaaccccagttttccctcgcatatttggtcatgaagcagcagggattgtcgaaagcgtcggtgagggcgtgacagagctcaaacctggtgatcatgtgcttccagtgttcacgggggagtgcaaggagtgtcggcattgtaaatctgaggagagcaacatgtgtgacctcctcaggataaacacagacagaggagtgatgctgaacgatggcaaatcgagattctcgatcaatggaaaacccatttaccatttcgttggaacatcaacgtttagtgagtactcggtcattcatgtcggttgcctagccaagataaatcctgctgctcccatggacaaagtttgcattctcagctgtggagtctccactggtcttggggccaccttgaatgttgcgaaacctccaaagggttcaactgttgctatatttggactaggtgctgttggcctttctgcatctgaaggtgccagaattgctggagcttcgaggatcattggtgtcgatctcaatccgaaaaggtttgacaaggccaagaaatttggcgttaccgagtttgtgaacccaaaagatcatcataagccagttcaggaggttcttgctgaaatgactgacgggggagtcgaccgaagcatcgagtgcacaggaagcgtcaatgccatgatctctgctttcgaatgcgttcatgatggatggggtgtggcagtacttgtcggagtgccaaacaaagacgacgccttcaagactcatcctatgaatttcctgaatgagaagacgctcaagggcaccttcttcggcaactacaagccgcgcaccgaccttccaaacgttgtcgagatgtacatgaggaaggagctcgagctggagaagttcatcacgcacgaagtctgtctctccgagatcaacaaggcgttcgactacatgcttaagggagagtcgctccgctgcatcatccgcatggacagatagaggagcctcagcagccgatcgggtttgcccgataagttcgatcaggtttccgaatgtacgattgccaataaaagtcgaaacataggatgttgaaagttcaaaagagtctctttggacacagtgtgtataatatgttttactatgaatggagtttgaagaaaaaaaaaaaaaaaa

SEQ ID NO: 858 - DNA, 3237 bp, Eucalyptus grandis
ctctctccatctcgctctgcgtgcagtttccgtttcccatggtcgaactgcgaaacgcagcgcctttcccctccgccgaacgccgcgcgtgagccccagcagggccgcctccgtcgagggcccgccgccgttccccgccgttccccgccgtcgctcctcggcggcggagacaacgcccgacgatgggtcgtcgccgccgggacctccccctcctggccctcctcctccctctgctgctgctgctcctcctcctcctgtgcctcgctgcctctgctcagaccgtgcagagcgacgtcgacgcaatgcaagccctcaagaagagcctgacgctcccttcctccctcgactggtccgacgccgacccgtgcaagtggccccaggtttcgtgcaccggcaatcgggtcgcccggatccagataggtatgcggggcgtgtccgggaccctgcctccggacatcagcagcctcactgagctgacgcggtttgaggtcatgaacagccagttctccggccccctcccgagtttcgccgggttggctcagttgcaggtgttgcttctaaaccgcaacaatttcacctccattcctgcggacttcttcactggtatgtcgtctttgcaagcggttgacctgagctataacgacttcgctgcttgggggattcccgctagcctgaaagattgcatctcccttcagaatttcaccgcgacccaagcgaacgtgatcgggcaaatccccgatttcatcaatgtggcgaatttccccagcctgatcgcgcttcagttggccttcaacaacctggaaggcgggctgcctgcgagcttcaccgggttgacgattcagatcctctggctgaatgggaaggccgggaattcgcagctcaacgggacaatcaatgtcatagcgagcatgacccagttggcacaggtttggttgcacagtaaccagttcacgggtcctatacccgacgtttcgaatttgaagaatctgtgggatttcagcgtgagggataaccagttgactggcgttgtccccgagtccctgatgaagcttcctagccttaaggttgtcaatctgacgaataatctgctccagggatcgatgcctgctttcaatactaaagctgttcaagtcgatatgactggtacgaatagcttttgctcgtccaatccaggcattccttgtgatcccacagttaatatactgctctccattgctcagccaatgggttaccctgttaaatttgctcaaggttggcaaggaaatagtgcttgtaactcatggacagggattttatgttctgggggcaacatcgatgttattaatttccaaaatatgggtctttctggaactattgctcctgaatattctaaccttacgtcgctgcagaggttgttgctgtcccacaatagtcttaccggtacaatacctagtgagctcacgacgctgcctaatctcaaagtgctggacatttcctacaacaatttgtccggtaaagtgcctacttttcggagcaatgtgaatataattaaagatggtaatcctaacataggtaaagacattgcgcctcctgcatcaccgacgactactcccccgggatccccaggatcggttggttctgacaacaagaaatccagtgttgcgaggattgtggctcctctagtgggtggtgcttctttgatcgcgctgcttggtttggtcttttggtacagaaaaaggcccaagagttctggtaaagtgcaaagtccaaataacgtattggtaatacatcctcgacattctggtgaccaaaatggcgtgaagatcactgttgcgggatcaagtgctaatggtggttctagcgaaacccacagtcaaggcagcggtgggactggggacattcatgtggttgaggctgggaatatggtcatttctattcaggtcttgaggaatgtgaccaacaactttagtcaagacaacatattgggaagaggtggtttcgggactgtatataagggcgaattacatgatgggacaaagattgctgtcaagaggatggagtccggtgtgatctcggagaagggcttcaatgaattcaaggctgagattgctgttcttaccaaggtcaggcacaggcatttggttgcattgctggggtattgcttagaaggaaatgagaggcttctcgtttatgagtacatgcctcaggggactctcagcagacatcttttcaactggaaagatgaaggactaaagcctcttgagtggacaagaagactcagcattgccttggatgttgccagaggggtcgaatatcttcatggtttagctcatcaaacttttattcatcgcgatcttaaaccatccaatatactgcttggggatgatatgcgggcaaaagtggcagattttggacttgtacgtcttgcccctgagggtggtaaaggctctattgaaacgcgtcttgctggaacttttgggtatcttgcaccagaatatgctgtgactggacgggtgaccaccaaagccgatgtcttcagctttggagtgatccttatggagatgatcacgggaagaagggctctcgatgaaacccagcctgaggacagtgtccaccttgtgacatggttccggagaatgcacctcaacaaggacacattccggaaagccattgacccggtcatcgatctcgacgaagaaacactagcaagcgtaagcacgattgctgagctcgcaggccactgctgtgggcgggaaccttaccagaggccggacatgggtcacgcggtcagtgtgctctcgtcgctcgtagagctctggaagccatccgagccagactctgaggacatgtatgggatcgacctggagatgaccttaccccaagcactcaagaagtggcaggcctatgagggaaacagtaacattgacgaatcttcttcctcatttttagcgagcaatgagagcacccagacgagtattcctacgcggccgtctgggttcgctagttcattcacttcggcagatgggagatgaagggatgggagttctcgaaagaaactaaaagtaaaacggtaaatgtaggagtcgggttcgtattgatgattcatggaggtttgctttgttcgctgtcgcctgttaattatgagatatttgcgtctttctttctttctttcttctggtatgtgttgtagagatgatcatgctatgtagcttgaacttgaatggcgaaagtataatttatgtgcaggctttcttggta

SEQ ID NO: 859 - DNA, 2478 bp, Eucalyptus grandis
ccgagtcctaatggctccgccatcctcgctcctcctccctctcttcctctccctcttcctccaatcttgtcggctctccacctcggcgccgcccagcctccccaaacgcgcatccctctccgtggagaaccccgacgacctccttgtctccccctctggcgccttctccgctggcttcttccccgtcggccacaacgcctacggcttcgccgtctggttcagccaccccccctgctccggcgccgcctgcacgcccgtctggatggccaaccgtcaggcccctgtcaacggccgccgctccaccttatccctcctcaactcgggcagcctcgtcctcaccgacgccggcgccgaggtctggtcttccggcaccagctccccctccgccgccgagctccgcctcaatgacactgggaacctcttcctcaccgacggcagcggcggcgtcctgtggcagagcttcgactcgccgaccgacaccctcctccctcagcagcccttcactggaaaaacattcctgatctctgctcggagccggtacaactactcgaccgggttctacaagctttacttcgaccccaacaatgtcctccgcctcctcttcgacggcccgtcaatctcaagcgtctactggccttacccgtggttctcgaatgatcagcttggccgattcccctacaacagcagccgcatcgctgtgctcgacctgctcggccgcttccagtcctccgacaactactcgttctccacctccgattacggcgtcacggctatgcagagaaggatgaccctcgactttgatggcaacttgcgggtctacggccgcgagctgggctcgactgtctgggccgtgacgtgggaagcgctcagcatcccctgcttcatccacggcgtgtgcggcaacaacagcctctgtagctacgacccgacccagggtcggagctgctcctgcgtgcctgggtacgttcccaaggtcccgggcgactggtcggccggttgcgtgcccgatttcaccttctccgacgggtgtgtcgccgacgacatcaggttcgtgaagctccagtacgtcgatttctatgcctacgactacaacatcagctttaacaccactctcgcgaagtgccggcagacttgcctgaacctgtgcaactgccgaggattccagtacagtgggtcgcgctccggcggcatgtccgattgctaccccaagatcgagctcctgaatggccataacttgcccagcttccccggcgagttcttcatcaaggtccccaagaataagaccttcaccgtggaccagctggtgaagaggactcagtacacttgccctcccacccaggaggagaaggtcccgcacaggagcaaagacggtgggttgagctttatgctctggttcgcctgcgttgttggagggattgagatcgtggtggtgttcttggtgtggtgcttcctgattaggaaccagcaggacgttacttctgcgcaccagagctacctcaacaccgcagccgggttcaagtggttcagctacgatgagctcaagaaggcaacgaggaatttcagcaaggagatcgggagaggcgcagcggggatcgtgtacaaggccttattgccggatgatcgggtcgtggcagtgaaggtgctcagcaatgccacaactggagaggccgattttctggccgaggctagcacgatcgggagggtgaaccacatgaatttgatcgggatgttgggttactgtgccgagggaaagcgcaggctattggtatacgagttcatggaacacggatcgctggcccagaacttgtcttcacctgagcttcactggaagaggcggtacgacatcgcggtagggaccgcaaagggtctagcttatctccacgatgagtgcttggagtgggttttgcattgcgacgtgaagcctcagaacatactcttagactccgactaccaacccaaagttgcggattttgggctttccaagctaatggaccgagggaaggtgaggaattctgatttctcaagaattagaggaacccgagggtacatggctcccgaatggatctcaaatctgcccatcacatccaaggtggacgtctatagctatgggattgtcatgttagagatggtgaccggaattagcccgatgacaagtgtccaatcattgcagagcggaggggatgccaagcaaatctggcttgtcccgtgggtgaggaataaaataaaggggccacggaggacagggtcccgtctgaaaaagatggtgcatcctgagctcaggggcgactacaacttgaagcaaatggaggtcttgatcgaggtcgcgctcaagtgcgtggaggaagataaaaacgccagaccccccatgagccaagtggtggaaatgcttcttaggcatgagaatgatagttagattagggtgcaaatgaagtgagattgatttagatgccatttctctgatccaaaaaaaaaaaaaaa

SEQ ID NO: 860 - DNA, 2682 bp, Eucalyptus grandis
gcttcatgttgagttgatacatctctagctccaacaccggagagtctccctagccagaaaagactctgaacgacctccaattatgccgagaccgaccccttcacctcctcatattcacatcttcttcctttcgtacatcccctgtctcgtcttcctgtgcttactctccaatgctgcagagtctcaaatccaagatcaagaacagcaagtcctgttgaagctgaggcaatcctggcgagacccatcttccctcgaccactgggtcgcctccaattcatcctcccactgcacatggcctgagatcacatgccaagaaggctcgatctccgagctcaatcttgtcaacctgaacataaattattcgatccccccattcatctgcgacctcaagagtctgaccaagctcgacatctcctacaacaatattcctggagggtttcccactgttctctacaactgttccaagctcgtgtacctcgacctgtcccagaattactttgaaggtcctatcccatccgatatcaatcgcatggccaatcttcaggtcctgattcttgctgccaacagcttctcgttcaacgtcccagcatcagtagcgaggctgcggaggctgaggatccttcaccttaaccagtccgagtacaatggcacataccctgaagagatttttggcctctccaatcttgaagaactgagcctcgggtacaatgacaagttcgtgccatcgcagctgccacagaacttcacctccctgaagaagctgcggttcttctcgatgccgcagacaaacctgtatggtggaatcccagagacaatcagcgatatggaggctctcgagcacttggatgtggggataaatccactgacaggagagatcccgggcagcatttttgctctgaggaacttgagcaagttgtacgtgtacaataccaatgtgtccgggtcgatccctcaatcagtgagtgctgcgaacctgagcaggattgatctatcttttaataacttgacggggaacatacctgaagattttgggaagctcaagaatctatcctgcttgagtttgcagttcaatcaattatccggtggaatccccgaaggtattgggcgtcttcccgctttgtctgatgtcaggctgtccaaaaacaatctatcaggcacgatcccccccgacttcggcaagttttccccactcagaagatttgaagtggccttcaacagcttgactggcgcattgcctgaacaactgtgccatggcggcacgctgttcgggttggccgttatggacaacaatctcggcggggagttgccggagtcacttggaaattgcagtactttgtctgtagcaatgttgaataacaatgggttcaccggcaatgtgcctggaggactctggatgttgcggaacttgacggctttgatcttgagtggtaatggattaactggtgagcttcccgaggagctttccccaaacctcactcggatcgagatgagcaacaacaaattcttcggcaagattccgagcacggtgtcttcatggaagaacttggtagtgtttgatgccagtaataacctcctcagtggcaccattccgactgaattaaccaagcttcctttctctggtggcgcttttgctaggtcagaacgagctctctgggaatcttccgacagccattgtttcgtggaactccttgaacactctgaatcttagtcacaataaattgtcgggaccgattcctagcaaaatcggtcttctaccggtactcacgcagttggacctgtctgaaaaccaactgtctggcttgattcctcctgaaatcggccagctgaatttgaaccttctcaatttatcctccaatcgcctcagtggaaaaatcccaaatgagttagagaacgccgtgtacgacaccagtttcctgaacaacccgggcctctgtgcatccaattcattcatgaggctcaatgtctgcaattcccgatcccgtagatggagcaaaagctcgccaaccaatctcgccttgattgtgctcttggccattgctgtggcaatatttgttttgatggtggcgatattcacaatcagagctttccaaaagaagagagacgagtttgatttaactccaaaaccgactccattccaaagttcgaatttttcagaatcgaatgttctgtcgggattgaaggagcatgttgtgatcagaatttgcggatcagggaaagtacacaatattatcgagaatcgttctggtgacgctgttgtggtaaaagggatttccaattagccggccgtttgggtgatatatgcaggaaccaatggagaggtacgattagcaatacccataagaagagattcccacatctcgctctaccgcagacggaagacttgaatccttattgtaatcaactaggcaattctcaaacgcacttcaagtggcatattctcacgttctcaaactcgttcaactgaataagaaaggcatgttttagctatcagttcgtgtaactatcttgttctgtcctagcgaatagtttctgttgaaaaaatatggcttcgaattgggtaggataatgaagtcggatatctagagtaatcaagtcggactttgatgcgtgatatcactttctttaataatttatttgtcccataatattattactggtcaaaaaaaaaaaaaaaaaaaaaaa

SEQ ID NO: 861 - DNA, 3453 bp, Eucalyptus grandis
cacaatgtttctttccttcctctccttcctcctcctcctgctcgccggcgccgcggctccgccggcgctgtccctcaaccaggaaggcctctacctccacggcgccaagctctccctctccgaccaggactcctccctcgccgcctgggacgaccgcgacgcctccccctgcggctggccgggcgtcgggtgcgaccgcgcctccggctccgtcgtctccgtcgacctctccggcgccaacctcggcgggcccttcccgctcctcctctgccgcctccccaacctcaccttcctctccttcttcaacaactccatcacctccctccccgccggcgtctccgcctgccgctccctcgtccacctcgacctcggccagaacctcctcgccggcgacctccccgcctccctcgccgacctccccggcctcgcctacctcgatctctcggccaacaacttctccggcgacatccccgccagcttcggccggttcccgaggctcgaggtgctgtccctcgtgaacaacctcctcgacggcgccatcccgggcttcctcggcaacgtcagcacgctcaagatgctgaacatctcgtacaacccgttcgcccccggccggatcccgccggagctcgggaacttgacgaacctcgaggtgctctggctcagcgagtgcggcctgaccgggaagatcccggagtcgctcgggaggctcaagaggctcaccgatttggacctcgccttcaactacttggagggccccataccgagttcgctaaccgagttggagagcgtcgtccagattgagctctacaataactccctgaccggggagctgccggcggggctgtcgaagctgacggcattgcggctgctcgacgcatccatgaaccggctcaccggcacgattccggacgagctgactcggttgcctctcgagtcgctcaatctctacgagaaccagttctccggggagctgccggcgagcattgccgactcgcccaacttgaatgagctgaggctgttcaacaaccgcctcaccggcaagttgcccaaaaatctcgggcaaaatgcgccgctgcaatacattgacgtgtcgaccaataacttctccggcgaaattccggcgagtctgtgcgctaatggcgagctggaggagctcctgatgatagagaactcgttctcgggtccgatcccggaggcgctcggccgttgccagaggttgacccgagtccgcttgggcaataaccggttgtccggtgaagttccctcttctttctggggtttgcctcgggtttctctgctcgagcttgcggataacaagttgtcgggccccattggagaagaaatagcgagagctagcaatctctctgttttgagtttatcaagaaatgagtttaccgggcctcttccaaaagggattgggactatagtgaggcttttagacttctccgccagtgagaataagcttactgggtcgctgccggagagtattttgaaccttgggcagctggggaggcttgatctccgcagcaacgatctgtctggtgagttgcccagcggcattcgtcactggaagaagctgaatgagctggatttggcggataatcggctctcggggagtattcctgctgagattgggggcttatcggtgctcaattatctcgatctctcggggaatcagttctccgggaaagttccggccgagttgcagaatctgaagctcaatcagctcaatttgtcctacaatagcctatctggtcctctgcctccaatgtttactaagcaaatgtacaaaaacagcttcttgggcaaccctggcttgtgtggaggcgaaatgaagggtctgtgcaatggcggaggcgaagaaagaaactccggctacgtgtggctgcttaggtcgatctttatacttgccgggttggtttttatcgtcggcgtcggttggttttacatgaagtataagagcttcaagaatgccaagagagctatcgacaagtcgaagtggacgctgatgtcatttcacaagctgggctttagcgaagacgagatcttggattgtctcgacgaggataacgttatcggaaccggagcctctgggaaagtatacaaggttgtgttgagcagtggggacgcggtcgccgtgaagaagctttgggatggacccaggaaggaaagtgagagccatgatgtcgagaagggtcctgtgcaggacgatggctttgatgctgaagttaaaactcttgggaagattcggcacaagaacatcgtgaagctctggtgctcttgcactacgagagactgtaagcttctcgtttacgagtacatgcctaacgggagcttgggcgatctgctgcatagcagtaaaggagggctgttggattggcctacgaggtaccggatcgcagtggacgccgcggaggggctctcttatctgcatcacgattgcgtgcctccgattgttcacagggatgtgaagtcgaacaacatcttgttggatgcggatttcggagcccgggtggctgatttcggagttgctaaggtggtggaacggactgggaagggccatgagtcgatgtccgtgattgctggttcttgtggctatattgctccagaatatgcatacacgctcagagtgaatgagaaaagcgacacctacagcttcggggttgttcttttagagttggtcacggggagacgtcccgtggatccagagtttggggagaaggacctggtcaagtgggtatgcatcactttggatcagaaaggcgtggaccaggtgatcgacaggaaacttgattcctgcttcaaagaagatgtatgcaaggtcctcaacattgggctgcagtgcacgagccctctcccaattaaccgaccatccatgaggagggtcgtcaagatgttgcaagaaatcagcgctgaaaacgcaccgaagaaagtcattaaagatggcaaattgacgccttattactatgacgacgcctcggatccaggaagcgtggcttgagaagtttttacccctctttgtcacgggaaggagaaactattctccttttgaattttgcagagtaccctcagtactcagtcatcctgcctgatgctttgcttcgacgaccgatgaagaaatcaaaagccagaggaagagttttttctttttcaaggtggaaatatccaagaaagaagaggggttggccagaaaagaaagaagtttagtgcatatttacacctgtaaagtttaatatcatcatttgaattttcaaatccactgagtttgtgagtaggttcttggttttacaccttcctgagagtgctctgccctttgtcttcaaggttcatttgaaggtgcaatctctggtatagtcaaggtgtttctgaaaatgagaaactgtggcttttaattacaattcccgcaatagtgaaatatatcacttttggctttccatgaaaaaaaaaaaaaaa

SEQ ID NO: 862 - DNA, 2728 bp, Eucalyptus grandis
agccatggatagcaaaaacagtagtccgtggtcattcatactcccaattttcttgctttgctcatctctgtacacccacctctgtcttggcacagacaagctcgatgcgaatcgatctatatctggtaatcaaaccttaacctcatcgggtggcaactttacgcttggcttcttctcgccgggtaactccacgtactcctacataggcatctggtacaacaaaaacaaaatcagcgtgcaaaccgtcgtctgggtcgccaaccgagacaaccctgtcactgacaggcactccactggactgaaggtctcaggtggcaatcttgtgattgttaacaactccgaagtccctgtttggtccacgaatctgactgcttcttcatctggatcgagctccatggtggcggttcttgaggacgacggcaacttcgctctcaaagcggcgccgaattcttccgtgactctgtggcagagctttgattacccgacgcacacgtggcttcccggcgccaaattcgggatcgacaagcgcaaaaacacaagtcagcgcttgacatcatggaagaacgccgaggacccttcgacaggtttgttctctctcaatctccagccattcggtgagtactacatatggtggaataggtctaagcattactggactagtgggacgtgggacaatcagacgaaaattttctctttggtccctgaaatgagagcgaactatatttatgagttcaaatatgtggacaatgagaacgagagctacttcacctattcaatcaaaagctccttcaacaccatatcaaggtttgtgatggacctttctgggcagatcaagcaggagtcctggttgccttcccaggcgtggaccatgttctggtctaagccctcgcaacaatgcgatgtgtatagactttgtgggcctttcagtgtttgcagcgagcagagcgaagttttgtgcaactgcttgccgcgatttagcataagctctccagtggattggaatcggagggattggtctggtggttgcaagaggaattcgaacttaaattgtgcagcgaatgcagagaaagaccgtttctggcctatgtctaacatgaaattgcatgatgctcctcaatctttagttgcagagagcgatcaggaatgccgaactgcttgtttgagcaattgctcttgcacgggttatgcttttgaaaataatgcctgctcaatctggattggggatctcttcaatgtggaacagctcaaacaaggcactacccctggaacgagtttctatgttcggcttgctgcctccgacattaaggatcccagcaagaagagtaaagtaactgcaatagtggcagggtctgttagtgccgcggtagcgatattagccattgtctcgtttgccatttggagatggaggagaggggcaactgtaacaacaaaagaagtggagggttcactgatagcctttgcataccgggacttgcaagtagcaacaaagaatttctcagagaagttgggtgggggtgggtttggttcagttttcaaaggaacattacctgattcaagtcacatagcggtcaagaagcttgaaagcataagccaaggtgagaagcaattccgaatggaagtaagcacaatcggcaccatccagcatgtgaatcttgtcaggcttcgcggattctgctctgaaggtgacaagaggctgttggtctacgatttcatgccaaatggttccttagactatcatctctttcatagaaaggactcgaaggccttggattggaaaacgaggtaccaaattgctttgggaacggctcgaggtctggcttatctccatgagaagtgcagagattgcatcatacattgcgacatcaagccagagaacatccttctagatgctgaattctgtccagaagtggcagattttggcctggcaaagcttgttggccgagatttcagcagggtgttgacaaccatgagaggcacaagagggtatcttgcgccggagtggatctctggagtggccataacagtaaaagctgatgtttatagctatgggatgatgctttttgagtttgtgtcgggaaggaggaacttagagctatcggaaaatggggccatcgagttcttcccaacatgggctgctagcaagatagctaaaggtggtgatctgcttgatcttttggacccagacttggagaaaaacgctgatactgaagagctaaataggatatgcagagttgcttgctggtgtgtccaagacgaggaaactcacaggccatcgatggggctggttgttcaagtactcgaggggttgttggatgtgaacctgcccaggataccgagagcccttcaactgcttcttgataatcaggagcatgtagttttcttcactgagtcgtcatcatcggaccagaattcccagacgaatagtaatacctcaacttcttccttgcagaacccaaatagttcatcttggacgaagtccgagtcttgaggatgataagataaatgcttagtacaagaagtgcttcagttatatagtgcatacgctcctctgctttttctgtagtcaagagcgaatctcagcatttggggattggctttcttggggcttttccccctagctatttatgttgcacgtagatacaagcaagcttggaataagtgcgcggccagaccagttgtaaagattcttaattctatataatgatctgtgctgaaaaaaaaaaaaaaa

SEQ ID NO: 863 - DNA, 2341 bp, Eucalyptus grandis
attccgttgaaagagagaacccaagaactgcagcttgaggagttcttgattgttctctctccctccctctctccctccttgagctgaagtctcaaaccgactttcttcccattatgttctacaggcaggcggggactcacgcttgcaaccccctcgtgatgatgacctgttgttaatgattgttgctgtaatgtcgctgagcaagaaaggagcgcttgagttcaattcgaatatctgaatcactctctcttgagtacttcatgaagcttcttcaagcagtcattcccacgacctcattgcttttcggtgtacttcttctcatccccttagttgttgctgatctgaattccgatgtacaagcactccttggtttcgcttcggccgtcccacatgcccggaaactgaattggagcccttctattccgatttgcagttcttgggtaggcataacttgcaatgtagacaaaacccgggtgacaaaggtccgtcttcccgctgttggtctttatggctcactgccgtcaaacactttggcaaagctcgatgctcttgaggtcttgagcctacgttctaattatttaaccggcaatcttccttctgatgtggcttccattccttccctccaatacttattcctccagcataataacttttctggctctctcccgatctctttgtcatctcagctcaatgtattggatttgtccttcaactcttttagtggtggcataccgccatccattcagaagctcaataggcttgctatattttaccttcaaaataattccatttctggtacaattcctgaccttaaccttcccaaacttaaacttttgaatctgagctataacaacttgtcgggttccatcccgaattctctccaaaaatttcctaactcttcattcgttgggaactctcttttgtgcggacaacctcttagccaatgctccactcttgctacctctccttctcctgcgcctgcacactcagaacagccaacaacaggtccttttggccaaaaagtcgcttcgaaaaagaaaatcgggtcaggtgctattattgctttagttattgggggttttgcagtgctcttcctgctcatggtggttgtccttgtctactactcgaagagaaaagatggtagtaatgtactgaaagtgaagggaactaatggcacaagtcaaaatccaaaggactttggaagtggtgtacaagaaccagagaagaccaggctagtattctttgaagggtgttcttacaactttgatcttgaggacttattgagggcttcagccgaagttcttggtaaggggaggtatggaacggcttataaagctattctggaggatgggacgaccctggtggtgaaacggctgagggaagttgtggctggcaaaaaggagtttgaacagcagatggaacttgttgggaaggtgggacgacatgccaatatcgtgccactgcgtgcatattactattcgaaggatgagaagctcttggtttatgattacatgccttatgggagcttgtttgtacatttgcatggagataaaggttctggaaggacgccattagattggaattctagaatgaagatctcccttggaacagccaaagcgattgctcacatacattcagagcctggagctaagtgtgttcatggaaacatcaagtccttgaatgtcttcctcactcaagatcacgatggttgtgtttcggatgttggactgactcctctcatgaatttgtctgcaataactccccgagttattgggtactatgctccggaggtgattgaatcaaggaaagttactcagaaatctgatgtttacagctttggtgtgctccttcttgaaatgctaacaggtaaaacacctctcaagcatccgggacacgatgacgtcattgatcttcccaggtgggtccggtcagtagttcgagaggaatggacggctgaggtctttgatgtcgagctgctgaagtacgagaatgtggaggaggagatggtgcagatgctgcaaattgctctcacgtgtgtcacaaaggtacctgatatgcgccccaagatggatgaagttgccaggttgattgatgaagttcgggaaccagaggcaaaggatcggccttcttctggagctgaatccaatgcgcaaaccccgtaataacagattttagattctccttttccttccctggagttgagctgcagtatctaagagagcaatttgctctcttgtaagctgtgatttacttgtatgctttgccctgtagttgaattctgtatggttttttatccattttagtgaagtgctagtctgttttatctaaaaaaaaaaaaaaa

SEQ ID NO: 864 - DNA, 2380 bp, Eucalyptus grandis
gaaagttagagagttagagagagagagagccagcatgttctctctcttcttcctcctcctcctccctctcctctccgcctccgctcccgttccgcacccctacggcaacgtctcgtaccacatcgactgcggcggcaactcccccgtcgtcgactccttcaacaccacgtggctccccgaccgctacttcacggggggcgccgccgccgtcgtctcggagcccctccgcttccggcagccccaggagaagacgctccgctacttccccctctcctccggcaagaagaactgctacgtcctccccggcctcccctccggccgctactacctccgcaccttcaccgtctacgacaactacgacggcaagtcccaccccccgagcttcgacgcctccgtcgagggcaccctcgtcttcagctggcgctccccctggccctcccccgacctcgccggcggcagcggcgcctactccgacctcttcgccttcgtccgcgacggcgaggccgacgtctgcttctacagcatggccaccgacccccccgtgatcggatccctgtcgctcgtccaggtcgatccgctgtcttacgattccgcgtccgtgggcaccaatttcatcctggtcaactacgggagactggactgcggtgacggtcagtgggggccgggtttcagcgacgacgccgactacttcggccggtcctggcagtcggattacagcgcccggaccgccgccacgcgtaaaatcatcgacgccatctcgaccgcgagcagcatcgcggggaccaatcggcagcccaattatttccccatgaaattgtaccagaccgcggtgacggtcggtcaaatgggggccctggagtatgaattggaggtggacgccaagctggattacctgctgtggttccacttcgcggagatcgatccgggagtgaacaaggcgggccagagggtgttcgatgccctggtgaacggagcgaacgcgaccaggatcgatatctataaggaggtcgggcgattcgcggctttcgattggcattacaccgtgaagaatttgagcactactgttttgaatgtgaagctggtgcctgttgttggtgccccattgcttagcggaattgagaactacgcgctggtccctgccgatcttgctactgatcctcagcaagtgattgctatgagatcattgaaggagtcacttcgtgttcctgatagaatgggttggaatggtgatccttgtgctcctacaaattgggatgcttgggagggagtgacatgccataccaacaaggacaaaactgcccttgtaatatatcagatagatctcggaagtcaaggcttgaagggctttataagtgatcaagttgccctcctgtcgaacttgattagcctgaacttaagttccaattctttagggggtaatcttccatctgggcttggtcaaaaatctcttgtacgactggacttatccaataatcagttcgtgggttccattccagatagtctaacagtgtcaaatctgcagcttgtgctattaaatggtaaccaattggagggaagagtaccggaagaagtctactcaattggtgtgcatggtggagaaatagacctctctgataacaaaggcttgtgtggtgtacctactttgcctgcatgtcctctattttggcaaaatggcggcttgtctactggtggtaaaattggcatagccatatcgtgtctcgttgtattctctgtgctgcttgtggtggtatacatatgctgcataagaagggggaggcatgattatgactttgctctacctcatgaattgatggcgctctctgcaaagagaaaccggtatcagagacaaaagtcgctaatggtcctagagatggaaagccaacatgctaaaatactgccatcgaatttgagtccccattgatggcctgcagtagtaagaacatcaattttgacagaattttaccacaaaggagcataaatggacctcgtctggtcgtgtaaattgattaaaagagatgcaagtggcagcagcgcctatagcaaggttgacttgtaggcctcagtttggcttcttccagacaatttgtctcttcaatgggctcacaagaagtttcaaaatctgtacaatacattggatcattgatggaatatagctacattgtatcataccgcgattctgacatacgttgaatacgtgctgcgaattgacagttcaagttatgtaaatggcttcacttattcgtgtcaagtggttctgatacatcacatcaatacttagtgtatgattggcttctagctgttttcgcccatactatgggctctttggctgaataacgagggctggtccatctttggtgtgctaaaaaaaaaaaaaaaaaaa

SEQ ID NO: 865 - DNA, 2735 bp, Eucalyptus grandis
gagaagaagaaaactccaagcgacggcgctgttcacgcacgattcccgccggcctcgtcgccgtcctctgctgctgtccgcctgcgacgtcaaaacgcgacgcggccctcctcatcttcgattctctgtccccccctctctgtctctcgcgtttgccatagctgagaaaagcttcgagtgtgccattttcttgaaaagacaaagctccccatttcgagcaaagacccaccaccatccatccgcgagccatgacgctctccctcctcctctctctcctcttctccctcgccttcctccactgctgccgccaccctcctcgcgcgctttcctcgcccctctcggagctccacgccctcatggcactcaaggccgccctcgacccctccggccgggtcctcacctcgtggtcccgcggcgccgacccctgcggcggcggcgcgtcgttcgagggggtggcgtgcgacgagcgcggccgcgtggtgaacgtctcgctgcaggggaagggcctgagggggcggatcccgccggagatcggcgggctcgggagcctgaccgggctgtacctgcacttcaacgccctgggcggcgaggtgcccggggagatcggagggctgaggatgctgaccgacttgtacctggacgtcaatggattctccggggagattcctcccgacatcgccaacttgactaatctccaagttttgcagctgggctacaaccggttctccggcggcatccctagacagctagggtccctgccgaagctgaccgtcctcgctttgcagtacaatcgcctgaccggcgccatccccgcgagcttgggggactcggcgaacctgaagaggttggacttgagctacaacaatttcttcggctcgatcccggcgacattgaccaatgcttctagtctcgaagtcctggacgtgcgcaacaataccctgtcgggctatgtccctaccggcttgaagaggctcgatgatggtttccaatatgaaaacaaccctgacctatgtggagtcgggttccccaacgtccgaccttgtccgaccgtttacctggaccggcccgagccgctccgacccgatactctttcgaagaagaacattcccgagtcggctgatttgaattcgacctgcgggaaagcgcactgtccgaacagattaagtggccgaagagccggtgttgttttaggggtggttgcagtcgtagctgctatcgggttcgctgtcgttggatttctcaccttgtcatggcaccagcatcgaaagcagaggaattcaagctctgtagacgttttggataagcgggtccgtgccagtcgagcccttgagaatcgctcgaagagggcctctgctctcatcagtctcgagtactcgaacgggtgggatccgctggccaaaggcggtggcgggagcgccttctcccaggaggtttttgagaacttcatgttcaacttggaggatgtggagcgcgcgacccagtctttcctggagagcaatttgctggagaagagcagcttctcttctgtacacaggggaatcctcagggacgggtcaaccgtcacggtaaagcgctatgccaagatgaactgcaagtccgatgaggccgaattcctcaagggcttgaaactcctgaccaaactgaagcacgaaaacctggtcaggctcaggggattttgctgctcgaaagggcgaggcgagtgcttcctgatctacgagctcgtgccgaacgggaatttgctgcagtatcttgacgcgaagcctggaagcgggaaggttcttgaatggcatacccgagttgcgatcataatcggcattgctcaaggtatcagctacatacatgaagatgaaggagacaagcccagactagtccaccagtcgatatctgccgagaaagttctcatcgattactggaacaacccgctgctttcggacccaggtctgcaccacctcctcgcagacgatgtagtctttgctatgctcaaggccagcgctgccatgggctacctcgccccggagtacgcaagcaccggctacctaaccgagaagagcgatgtgtacgcattcggtgttctggtgctccagatcctatcggggaagcgtgtgatcactccatcgatccggcacggagtggaagcatgttgctttgacgaattcatcgatgagaaccttgaggggaatttcttggagactgaggcgacccagcttgctcagatcgcgcttctttgcacccgagactcttctatcgacaggccattgatgagaactgtggtgcaagagcttgatatgctgatcggcatttcttgacagttgcggttttgcttgtcaccgtgattttcggtcgccaagaggcgagactatcacaattctaattaactactaggttaatcacagatttccagatgtgtcagcagccgcatcctctataacagttgacgaatttctctcttaagcatcggcatagtaatagttattagggaagagtaagggcatgagtaagcttgtaatgcatcaaagcatgtaactggtatgcattgagtgcaggactcttaatagttagagggtgccctatgcattatactcataagagtgctttgaaaagagactgatggctgttcggattcgaatcccttttttccttttgtttaatttaaggagaccatgttgtaaatgattatgctgtttggcgacgagtgaatagaccgtttctgacttaataccaaaaaaaaaaaaaaa

SEQ ID NO: 866 - DNA, 3062 bp, Eucalyptus grandis
ctccctcctctccctcaaatcctccctcagagatcctcactctaccttccatgactgggaccccacgccaaccttctccaaccctactctccagaaccccgcatggtgttcctggtctggcgtcaaatgcaacccacaaacatcccaaatcacttctctcaacctctctcgccgcaaactctcccgtgcaattccggcggaaatccggtacttgacgagcttactgcacttgaatctgagtgggaatgcctttgatgggattctccagccagccatttttgaattgactgagctcaagacgcttgacatcaaccacaacaacttcaactcaacattcccaatgggcatatcaaagcttaaactcctgagagcctttaatgcctacagcaacagcttcacgggtcccctccctcaagaattagtaagtcttcagtatctcgagtatctgaatttgggtggaagctacttcgaaggagagattccctccgactacggcaactttccgcgacttaagtctctgttcttgcatgggaacgttttagaaggtcccataccacccgaattaggatcattggcacagcttgagcgcttggaaatcggatacaatcaatattacggcggtatcccgagtgaacttgcgcttttatcgaatctcaggtacttggacatctcagctgccaacctttccggttcgcttccgcaagagctcggtaacgtgacaaagctggagactttattcctctttggcaaccggttgaccggccaaatctcgcggagtttctcgagcttggaagcgctccaagctctcgacttgtccgacaatcaactgtcggggacgatacccgaagggctggggtcgttgaaacagctcgccaccttgggtttgatgaaaaacaacctcagcggggaagtaccacaaacacttggcgtgcttccactgctggagacgctccagctctggaacaactccctcaccggaatcctgccccaagggctcggatcaaacgccaagctgacgaagctcgacgtgtcgtcgaactctttcacggggccaatcccgccaaatctttgcctcgggaagaagctgataaagctgctccttttctcgaaccggctcgtcggcgcgatcccaccgtcgctggccaactgcacttccctctaccggctccgaatgcaggacaacatgctcaacggctcgatcccgcgcggcttcgggctcttgcctaacctgacattcgcagatttgagcaacaacttcttcagcggcgaaatcccggacgatctcggaaacggggtggcgctccagtacttgaacgtctcggggaactcattcgggaccaaattgcccgacaacatatggaaagctccgaacctgcagattttctccgccagctcgtccaaactcctcggcaaaatcccagatttcatcgggtgcaagagcctctacaagatcgaattggccgacaactcgctgaacggcagcatcccgtgggacattggccactgcgagaagcttctgtacctgaatttgagccgaaactcgctcgcgggcatcattccgtgggaaatatcgacgcttcctatgatcaccgacgtcgacctgtcgcgcaatttcttgaccggctcgattccgtccaatttcgataactgtaccaccttggagagtttcaacgtgtcctttaactcgctcaccggccctataccttcttctagcactatattcaggaatttgcacccttcttcgttcattggtaatgacggtctctgcgggggcgtgttggcaaagccgtgcggcggcggccgcggcgctgacgcgtccggcatggatgactctgaggcgggtcagcaacagccgaggcggacggcgggcgccatagtgtggatcatggcggccgcgttcggggtaggcctggtggtgttgattgctggcactaggtgcttccatgccacctatagtcatcggttcatcgagcgccaaggggtcggcccgtggaaattgactgcgttccagaggctcaacttcacggcggaggacgtggtggagtgcctgtcgatgagcaataagatcatagggatgggatcgaccgggacggtgtacagggccgagatgccgggcggcgacatcatagcggtgaagaagttgtggggcaagcccaaggagcacatgagaaagcggcgaggggtcctggccgaggtggaggtgctcgggaacgtgaggcaccgtaacattgtgaggctactggggtgttgcagcaatcgggagtgcaccatgctcctctacgagtacatgcccaacggaaacctggacgatctgttgcacggtaagaacaaggacctcaacctggtgaccagttgggtgacgcggtacaagatagcgctgggcgtggctcaggggatctgttatctgcaccacgactgcaacccggtgatcgtgcaccgtgacctcaagccgagcaacatactactagatgccgagatggaggccagagtggcggatttcggggtggcaaagttgatacagagcgacgagtccatgtcggtcattgcaggatcctatggctacatagcaccagaatatgcatacacgctccaagtcgacgagaagagtgatatttacagctatggagtagtgttaatggagatgctgagcgggaaacggtccgtggatcgtgaattcggtgaagggaatagcattgtggattgggtgaggctcaagatcaagagtaaggacgggattcgcgatgttttggacaagaacactggggcatcttgtgcgccagtcagggaggaaatgttggagttgctcagggttgctctgctctgcacagctgcgagcccggctgaccgaccttccatgagggacgtggtgctaatgctgcaagaagcacgtcctaagagaaaattgctcgacgacatgagtggtgacgatagtgttcctctgactaaaaaatcttaagggattcgctagtattgacttattttcttatgtacttacgagattattactgggtgggatgggtataggagtattgttcttcctgctatctaaaaaaaaaaaaaaa

SEQ ID NO: 867 - DNA, 1935 bp, Eucalyptus grandis
atgcatgtgacggtatatcgccgtcgcggcgagctcgcggctgccctgaggctcgtgctccgttcttggtccctgctgtgctgctgctgctgcttcttcttgttgcctctggccctcgccgccgacggcgactacgagatcttgctccgcgtcaaggccgcccacctcgaggacccggacggccagctcgacgactgggcccccaacgccgaccgcagcccctgcaactggaccggggtcacgtgcgagacccgcaaccgctctgtcgtcgcgattgacctctcgggactgaacctctccggtgggttcccgtacgacttctgccggatccggaccctccggaacctctcgctcggcttcaacttctttaacggcaccgtcgtggggccgtcgctctcgctctgctcgcacctccaggggctcaacatctccagcaacatcttcgtcggcgagctgccggacctctcgcctgggttcaccgacctccggttcctcgacctatcgttgaacaacttctccggcgagattccggctagcttcggccggttgccggcgctgagtgtcctctcgcttgtcgcgaacttgctcaacggctcgataccttctttcttgggtaatcttagccagttgactcagctcaatatcagttacaacccgttcgtgccgggccctctgcctccggagatcggaaacctgtccaggctcgagaatctctgggctgcgggatcgtatctcgtcggagaaatcccgagctcaatcgggaagctcacttctctgaagaacttcgatttgacccacaatatgctgtcggggaaaattcctgatgccatcgccgggttgcgaagcgttgagtacattgaactgtacgacaaccacttatccggcgagttgccagaggggatcggcaatttgagcaatctcctgcaactggacgtctctcagaacggtctcacgggcgtcctgccggagaagatcgctgcaagtccggtcacgtccctgaacctaaatgacaacttattcaacggcgagattcccgcggttctggcgtcgaacccaaatttgcagcagctgaagctcttcaacaactctttcaccgggaaattaccagccgatttgggcaagaagtccggcttggtggagttcgacgtctcgaccaactctttcaccggcgagttgcctgagaatctctgttccagaggcaagctccagaaagttatcgtcttcaacaatcgcttcacaggacgcttgccgagttcgctagcgagctgtgattctctcgaatacgtccgaatcagcaacaacgaactctccggcgaggtgccggccgggttttggggcctccaggcggtctggtaccttgacatgagctacaataagtttgaaggggcgatttcgcggtcgatttcggggcccaagggcctgcagtcacttctgatcgccggcaacaaattctctggtgatattccggcggagatttgccagctcttaaacctcaccgtcgttgatgtgagcaacaaccggtttggcggtggactcccgacgtgtatcaccaatttgggcagtttgcagaagctcaagatgcaaggcaatttgctcaccggcccgattccgagttcagtagggccatgggcccgtttggcggagttgaacctttcgaacaaccggctcactgggagcataccggctcaattaggcgacttgccggtgctgacgtacttggacctctccgggaactcgctttccggcgagatcccgacggagttgaccaaactgacgcttaataagttcaacatatcccacaataagctctacggcgagataccgccgggcttcgatcacgaactctatgtttcgggcttaacgggcaacccgaacctctgcagctcggatctgaagccgttcccgaagtgcacaagagcccggcccgtcgctttc

SEQ ID NO: 868 - DNA, 3352 bp, Eucalyptus grandis
gcacgaaatttctcttattcccctaaccatgcagcatcatgcatgatcaactttgctttcacaggattagtttattcatgccacgaagactcgaagagagacttcgattctcgccttttcaccggacacttgcgctgccctccgcctttccctgctattaataatagggtggttcctcgtccctattcgattctagcctctcctcttcgtcgtacgaaactcccaggcggcaccacggcgctcgtccgtcgtcgagcagcggcggagcacgagaagaagatggcggcgacggcggcgaaaccgccctgcaagcccgcttcctacttctgcttctcctcctccttctgcctcctcctcttcgtctcggcttccctcgcgcagagcgacctcgacgtgctcctgcagctcagggccgccctggccgcgcccaactcgaccgccctccacgactgggtcggcccctcctcctcctcctcatcctcctcgtcgccgccgccctttccgcattgctccttcaccggggtcacgtgcgacgccggctcccgggtcgtgtctctcaacctcactgacgtccgcctcttcggccgcgtcccccgcgaaatcggcctcctccgcgacctcgtcaacctcacgctcaccagctgcaacctctcggggaccctcccgccggagctcggcaacctgaccgagctcgaagtcctcgacgtgtacgacaacaacttcacggcccagctgccgccggaggtggtggggctgaagaagctgaagtggctcaacctcgccggcaattacttcttcggcgagataccggaggtttactcggagatggagagcctggagtacctgggcctgcaggcgaaccagctgagcggcagagtcccggcgagcctcgcgaagctgaagaacctccagtggctctacctgggctacttcaacacgtacgatggcgagattccggcggagttcgggtctatgaaagagctcagacgcctcgacttggcgagctgcggcctctccggcgagattccggtgagcctgagcgagctaaagaagttagactctctgttcctccagtggaacaacctcatgggcgttatcccccccgagctctcgaagatgttgagcctcatgtccctcgacctctccaacaattacctcactggagtgattccggcgaccttcgccgaactcaagaacctgactctgctcaacctgttcgcgaaccacctggaaggccagatccccgagttcgtgggcgagcttccgaacctggagaccctccaggtttggggcaacaacttcacgatgatgttgccagcgggcctagggaggaacgggaggctgctatacgtcgacgtcacgcagaaccacttcaccggcacgatccctcgggaattgtgccggggagggaggctcaagactctgatcctgaccaacaactcgttctttgggcccatccctgatgaattcggggagtgcaagtcgctgaccaaagtccgagtcggcaagaactttctcgacgggacgattcctcgggggatcttcaacctgccgcaagcaactataatcgagcttaacgacaatctcttctccggcgagctcccggcgcagatgtccggcgagaacttggtcatcctgtcgctctcgaacaaccggatttccggtgagatccctccggcgattggcaacttcagcggcctgcgtactctgttactggacgcgaacaggttctccggcaagattcccagcgagcttttctcgccgaggttcctactgagggtgaacatcagcgggaacagcatcagcggcaggattcctggttcggtcactgggtgcacttctctggcagcccttgatttgagcaggaacaatctcgctggcgagattccgaacggcttgtctagcctgaaagtgttggccgtcctcaatctgtcgagcaacagattgaccggtccagttccaaaggaaattggcatcatgaccagcctcaatacgctcgatttgtccttcaacgatctctccggcgaagtcccccacgaaggccagttcctcgtcttcaagaactcctccttcgccggaaaccagaaactctgctcgccaggccgcttctcttgcccttcgcggtcaagtgcctcgcgcacttcctcgagggttgtgatcacggcaatctcactcgtgaccgcggcgctgctcatcaccgtcacggtctaccaggtcctgaagaggaggcggcagggctcgagagcctggaagctcactgccttccagaagctcggcttcaaggccgaggacgtgctcaagtgcctggaggaggagaatatcatcggcaaaggtggcgcggggatcgtctaccgcgggtcgatgcccaacgggacggacgtcgccatcaagcagctggcgggacggggcggcaacgggctcagcgaccacggcttctccgcggagattcagaccctcggtcggatccggcaccggaacatcgtgaggctcctcggatacctctccaacaaggacaccaacctgttgctgtacgagtacatgcccaatgggagcttaggggagctgttgcatggttcgaaaggcggccacttgcagtgggagacgcggtatcggatcgccgtggaggccgcgaaggggctgtgctacctccaccacgattgcttgccgctgataattcatcgagacgtgaagtcgaacaacattctgctggattcggacttcgaggcgcacgtcgctgatttcgggctggccaagttcttgcaggacgccggcgcatcggagtgcatgtcgtccgtggccggttcctacggctacatagccccagaatacgcctacacgctgaaagtggacgagaagagcgacgtgtacagcttcggggtcgtgctgctggagctgatagccgggaggaagccggtgggggagtttggcgacggcgtggacatcgtgaggtgggtgaagaccgcgtcggaccccctcccgcagccgccgtcggacgcggccttggtgctggccgtgatcgaccgcaggctgggcgggtaccccatcgcgagcgtgatccacctcttcaagatcgcgtgccggtgcgtcgaggaggagagttccgagaggcccaccatgagagaagtcgtccacatgctgacaaacccgcctctgtccgccaccaccttcgccgtcggcgccaccccggacctcatcaaactgtaggggctctcctctcttttctcagtaaaataaaagcttatagtgctttgcaaatgatcgtggccagaagaggctttgtatgggtgaatgtaaaattatcgtgtaataaacttgtctgtgcaagtggtcgtgaatgtaaaaaaaaaaaaaa

SEQ ID NO: 869 - DNA, 2733 bp, Eucalyptus grandis
ctcatcagtcatcacatcccttggctgattcacaaagacttcgttgacctcaaaactccatagccacaaccttcttcctctcttctggctaagttcaatcaaactcattcttgagtcgaagaatttcatgtttgataactaaatgaatcctccatcgatgtcccctgtttcgattcatcataccctctttttcttgctgtttctaattccacgtccttctctagcccaagagaacataccagttggatcttctctaaccgccacgaatggcaactcttcttcatggctctctccttctggagactttgcattcggctttcactccttatccgacggcgacaccaagaaaaaccagctcttcttgcttgccatctggtacaacaagataccttctaaaacaatcgtctggttcgcaaatgaagaccgtcctgcccccgaaaattcgaagctaacacttgattctgattcgggtctcgtcctcaccaatccacagggtggagagctgtggaaacctgacaccgtcatcggcaccgtctcacacgctgtgctcaatgatacaggcaatttcattatcctggactccagttcagatgttaaatggcagagcttcgacaatccttgcgacacgttgcttccgtcgcaagtgctcggaaagggcaaaagtctctcctcccgtcaatcggaggagagcttttccagggggagattccaacttcggatgcgcgagagtggagacctcgtgcttaacactatcaacctgccttccgactatgccaacgaggcttattacagcaccgggacagacggcagctctaatgcgtccaccgcggggaaagaactcgtgttcagcaactcaggttccctgttcgtctcgagagcaaacggcgagaggttactcctctcgcaggggggcatatctcccgcgtctgattcttatcacagagtcaccctgaactttgatggggtccttactcagtatgtgcaccccaagaattctggttccagcggaagctgggcaacgctatggtcgcaacctgatgacatatgtgccaaagttcaggtacgtgatggaatcggcgtttgtgggtacaacagcatttgcactatgggtgagaataataggccaaaatgcgactgcccagaaaaattcaccttgctcgatcccagtgacaagtatggcagttgcaggcctaatttcacgcagagctgtgcggacgatcaggaaaggacgaagcttggtccgatggaggacctgtacgggttcgaagaactcatgaacacagattggccaacctccgattatgcactattgcagcctttcggtgaagaagagtgccggaactcatgcttgcatgactgcatgtgcgcggtggcggtttggagggacggccagagttgctggaagaagaagcttccgctctccaatgggaaaattgaccctaccctcaatgggaaggtcatgatcaaagtcccgaagcgagactttcgtcctacttacttcccgctcccggagccgaaggcaagagataaagagccaaaatctttggttttggtaggatcagtgcttttgggatcttctgtttttgtgaattttgtactattcggcgcttgcatggtgtttttcctaatctaccgcaagcaacttaagaaagtatccacgaaagggaatgtggtggagacgaatttgcgccatttcacttatcaggagctcttccgagccacggatgggttcaaggaagagctagggaggggagctttcgggattgtttacaaaggggtgatttcaaacaatgtagcggtggctgtgaaaaagctgagtagcatgatgcaggacaaggagaaggagttcagaaccgaagtgaatgtgatcggtcagacccatcacaagaatctggtcagattgcacggcttctgtgatgaagggcaagaaagactgctggtttatgagttcttgagcaacggctcgctgtcagaccttctctttgcaggagatccaaagttgaaaaccccctggaatctgagatgccagatcgcttggggagttgccaggggactaatgtacttgcacgatgagtgcccgacgcagatcatccactgcgacataaagccgcagaacatcctcctcgacaacaattgtgtcgctaagatctccgattttgggatggccaagctcctgatgatgaaccagagctacacgaagacgaacgtccgagggacgagagggtatgtcgctcccgagtggttcaggaacttgcccatcaccgtgaaagtggatgtgtacagtttcggagtcctgcttctcgagataatctcttgtaggagttgcttggcaagcgaatcaagtggggaagaaagagagatagacgccttgaccgattgggcttatgatcgcttcatggagggaaggttggatgcactagtggaaggcgacgcacaggctctacaagacacagagaagctgaagaatctggtcatggtcgcattctggtgtattcaagaggaaccctctttgaggccgacgatgaggaaggtgacgcagatgctagaaggcgcggttggagtgcctgatcctccatgtccattccctttcagtagctgcaacactgcaatcgttccataaagtcatgttggtttccgttttcatacataggggctgaactctgtgtgttcattacatgttagtactcttatcgtgctataataagcgtgttatttactaaaaaaaaaaaaaaa

SEQ ID NO: 870 - DNA, 2690 bp, Eucalyptus grandis
caaagacttcattcacctcaaaactccatagccacaaccttcttcctctcttctggctaagttcaatcaaacccattcttgagttgaagaatttcgtgtttgataaccaaatgaatcctccatcgatgtcccctgtttcgattcatcataccctctttttattgctttttctaattccacgtccttctctagcccaagcgaacataccagttccatcttctctaaccgccacgaatggcaattcttcgtggctctctccttctggagactttgcattcggctttcactccttatccgacggcgacaccaagaaaaaccagctcttcttgcttgccatctggtacaacaagataccttctaaaacaatcgtctggttcgcaaatgaaggccgtcctgcccccgaaaattcgaaggtagaacttacttctgattctggtctcgtcctcatcaatccacaaggtgatgagctgtggaaacctggcaacgtcggcaccgtctcgcgcgctgtgttcaatgatacaggcaatttcatgatcctagactcaagttcagaggttctatggcagagcttcaatgatccttgcgacacgttgcttccgtcgcaagtactcggaaagagcaaaagtctctcctcccgtcaatcggaggagagcttttccagggggagattccaacttcggatgctcgagagtggagacctcgtgcttaacacgatcaacctgccttccgactttgccaacaaggtttattacagcaccgggacagacggcagctctagtgcgtccaccgcggggaaagaactcgtgttcagcaactcaggttctctgttcgtctcgagagcaaacggcgagaggttactcctctcgcagggggacatacctcccgcgtctgattcttatcacagagtcaccctgaactttgatggggtccttactcagtatgtgcaccccaagaattctggttccagcggacgctgggcaacgctatggtcgcaacctgatgacatatgtaccgatgtttatgtcgagaatggaatcggcgtttgtgggtacaacagcatttgcactctgcgtgaaaataaaaggccaaaatgtgactgcccagaaaaattcaccttgctcgatcccagtgacaagtatggcagttgcaggcctaatttcacgcagagctgtacggaagattgggaaaggttgaagcatggtccgatggaggacctgtacgacttcgaagaactcatgaacacagattggccaacctctgattatgatctattgcggccttttcgtgaagaagagtgccggaactcatgcttgcatgactgcatgtgcgcggtggcgatttggagggatggccagagttgctggaagaagaagcttccgctttccaatgggagaattgaccctaacctcaatgggaaggccatgatcaaagtcccgaagcgtgacttttctcctagttacttcccgcccccggacccaaaggcaaaagataaagatccaaaaactttggttttggtaggatcagtgcttttgggatcttctgtttttgtgaactttgtactattcggcgcttgcatggggtctttcttaatctaccgcaagcgactcaagaaagtatccacgaaagggaatgtggtggagaccaatttgcgccatttcacttaccaggagctcttccgagccacggatgggttcaaggaagagctagggaggggagcttttgggattgtttataaaggggcgatttcaaacaatgtcgaggttgctgtgaaaaagctgactagcatgatgcaggacaaggagaaggtgttcagaaccgaagtgaatgtgatcggtcagacccatcacaagaatctggtcagattgctcggcttctgtgatgaagggcaagaaagactgctggtttatgagttcttgagcaacggctcgctgtcagaccttctctttgcaggagatccaaagttgaaaaccccctggaatctgagatgccagatcgctttgggagttgccaggggactaatgtacttgcacgatgagtgcccgacgcagatcatccactgcgacataaagccgcagaacatcctcctcgacaacaattgtgtcgcgaagatctccgattttgggatggccaagctcctgatgatgaaccagagctacacgaagacgaacgtccgagggacgagagggtatgtcgctcccgattggttcaggaacttgcccatcaccgtgaaagtggatgtgtacagtttcggagtcctgcttctcgagataatctcttgtaggagttgcttggcaagcgaatcgagtggggaagaaagagagatagacgccttgaccgattgggcttatgatcgcttcatggagggaaggttggatgcactagtggaaggcgacgcacaggctttacgagacacagagaagctgaagaatctggtcatggtcgcattctggtgtattcaagaggaaccctctttgaggccgccaatgaggaaggtgacgcagatgctagaaggcgcggttggagtgcctgatcctccatgtccattccctttcagtagctgcaacactgccatcgttccataaagtcatgttggtttccgttttcatacataggggctgaactctgtgttcattacatgttagtactcttatcgtgctataataagcgtgttatttaaaaaaaaaaaaaaa

SEQ ID NO: 871 - DNA, 2447 bp, Eucalyptus grandis
gttccaaaaaggagagagagagagagagagagagagagagagagagagagtttttcggaaatgaaggtagtgcagcagcttctactggtggctgtggcctggtggttgcgacaaggcggtgctcccaccgtggccggaaactgtgcacataggtgtgggagagtgcccataccttatcccttcgggctcgaaccccagtgtgcgaggtcgaaagagtttttgctctactgcaataccaccgatgggagcggtggtcaactattgttggggaatattccgatacgcaagatctcagtcggcgactcgaccatgcttgtcagcctccccgaactacacgaatgctacaacaagactggccagctagtaagcagcaccgataatctgtacatcaatctaacttcatatccaccgtacagagtgtcagccacccggaacaacctcacagtcctcggctgtgacacctacgtgctcatgaccgacagatatgggcttttccggagcggctgcatctcctactgcagcgagtacgtcgacttggcgaaggagaccacttgctctggtctcggttgctgtcaagcgtccattccgaaggggctcaagatgctccgcattagaatctcctccgtcgatggacacgtgtcggtcccattcaacccctgtggagtggccttcgcggtagacaaaatgtcattcaacctatccagcaggagactcccgaccttgaatgatttgggcaagagggcggaccttgttctggactggatgatcggatgggacgtcacttgcgcacaggccatgtcgaaccagtcgagctatgcctgtggcgagaacacttactgcgactacttcgcggatggaccgggttatcgttgcttttgcaagtctgggtacgaggggaatccctatgatcgctcccgggggtgtcaagacatcaatgagtgcaaggactcacagaaatacccatgtcatggaaagtgcgagaatcagcctgggaactatacatgtgactttgtaaaaaatggcaccggtaataatgcaacggacggcgacagtgataatcgtcgcgatatagctcttacaatgatccttgcgcccgtcgtctgcatatatgctggtgcttcagcctcggtcacatggaagtggaaaattagaaagataaactttagacgaaatggaggaaagcacttgaaacgtcagggagttaaaatctttacggaggcagagctggcaaaagcaaccaacaactatgatgaaagcaagaagctgggcgagggtggttttggttctgtctatagagggagaatagcagtggatgtcgaggtcacggtcaagaaacctaaagatgtgcacaagcctctaatgaagaagggattccaagatgaacttaaaattgtgacgcaaacaaaatacaaatatgtggcgaggctctatggcatatgtttggagactagaatacccttgctagtttatgaatacattttgaatggtaccctctttgaacacatccatctgaaaatgtcaaccatcttgagatcatgggaaaaccgactcagaatagctgctgaagttgcacttgcgctcaaggaaatgcattccagcgaaatcattcatggcaacatcaagtcaatgaatatacttctagatcaaaattactcggtgaaaatatctgattttggaacttcagtacttatatcaccggagcatagtcatctcatagccaccgaaatagaaggcacattgggctacatcgatccagaatatttaaccactggtaagctaacaattaagagtgatgtatacaactttggagttgtcctcgtggagttgctcaccgaaaagaagcctacaagttctgttactgataagtatggagagccaatcaatattatccctcatttcatctcttccgtgaaggacaagtcactctccggtgtcataaattttgaggctgctagtgaagatgaaatcaagcaagtagaaacgcttgctaagattgcagtgaagtgcttggaccacaacagtagaaagaggccaacaatgagtgaagtggctcagaaactccccccaattaaccggagctcgacggttgcagtagacaataaagagcccaatttcaaagtgcctggaccaatctgtcccactgttaagattccagtgactgactgtctctcttgtctgggattggaacaagtatgttcctgcagttgatcctttattcctatagtaacatgtagtaattgcccataaggacttttagggttgattgtgtgctttgaatatgtgttatgttgccatttgctatggacttatgtttgtgcaagcatttgggctaatttaagtgtgggaatctaatatactatatgtaaagccgtgcgttgaagtagatctatcttatggccattttgacattataataatctctctttccctttaaaaaaaaaaaaaaa

SEQ ID NO: 872 - DNA, 2040 bp, Eucalyptus grandis
gagacagagcgtaaggaaaccagttgatccgtccaccatgcgctcttccgttccctccctcttcctcctcttcctctgcttcgcccatggcaccgccgaccccactgacaacggcccttgccccccccagaggtgccgccgccatcacgggccgttggtccagttcccgttcctgctcgaacgcaagggccaacatgacgactgcggctacagtcgggacttccacttgtcctgcgaccagagcgggaacaccctgctctcgctcccggggaccccgcggccacttgtcgtcacggacatcgattacgagggcagttccatcagcgtgcgggaccgcgacggctgcatccccttgccgctggcgaacctcaaccactctatcttctcctacgagaagagccaacccagccagtatagtagttaccagccgccctacaactataccctgttccagtgtccgcgggacgggaggagcgagggccgcatgacccggctggattgccagagcacatctgcgtatgacgtcttcgccgtcgagtcctactcctacgtgggagacttgccgctggtgtcctgcatgaggagcgggagcatcgacttgctcccgaagatgattagtatgatgggcgaggttaatttggtctgggaaaagccggactgcaggctatgcacgaagaacgggtcgttgtgtcgggggaacgagaacggcatccgctgcatcaatcctcctggcggatacaaagaaagaagaaagctagagatcgcgggaggagtggtgggtttttttctctttcttgttgtattaagcggactcagctatgtcatcaatgaaaaaagaagagataaagcattccaactcaagatcgagagcttcttgcatgactatgaggccctcaagccgacccgttactcctacaatgacatcaagaggataaccaatgacttcgaggaaaaactaggccagggggcttacggaacggtctacaaagggaagctatcgaacgagattttcgtcgctgtgaagatgctggacaattcattcgggaatggagaagagttcatcaacgaagtgagcacgatgggaaggattcaccacgtcaacgtggtccggatggttggtttctgtgccgacggtttccgaagagccttggtgtacgagttcctgccgaacgagtctctggagaagttcatatttcagggcgaggacgctctcgaccctttccttagttgggagaggctccacgatatcgctcttggagtggccaaaggcatagagtatcttcaccaggggtgtgatcataagatcctccatttcgacattaagccacacaacatcttgctggataacaacttcaatcctaagattgcggatttcggtctggcaaagctatgttccaaggaacaaagtgcggtgtccatgactgcagccagaggtaccatgggctacatcgccccagaagtcttctccaggaactttggaagcgtgtcatctaagtcggacgtgtacagcttcggaatgctgctgctcgaaatggttggggggagaaaaaacgttgacgtgaacgcaaagaacatgagccaaatgtacttcccacagtgggtctataaccatctgaataaagatgaagagcttgaaatacgaatccgagaggatggcgaccgcaagatagccaagaaactggcgattgtggggctttggtgcattcactggtaccctgccgatcggcctcctgtgaaagcggtggttcagatgcttgagggagatgagtaccccgtcatgccaaaaaatccttttgtttcctccggttcaggggatgctgcaatcatgcgcggaaggctctggaacacagatctagaagttatcgtggaataagttcgagtgcccttttgcagtatgtcatctctccgtgactgaagccgtacgttatgtaatacaagaatctatggacttagtggaaaccattgatgtgctcccaccacttacttgtagtattagatccaatatatatagaggatttcatttctaaaaaaaaaaaaaaa

SEQ ID NO: 873 - DNA, 2693 bp, Eucalyptus grandis
gatctctcttcttcctttcttctgtcttcttagctcactcagcagattcgctgattttgagaacttgactgcttcaagcagtatgaaagcttttgtggcgctttccatgtgtcctgttctcttcttctcttgtaatgcccttctttccaatgcactagataccataacaacaaatcagtcgattcgagatggcgagaacctactctctgctggtgggacatttgagctggggttcttcagtgcaggcaatcccccaaagcggtatctgggaatatggtacaagaaaataaccacaacgacaatagtgtgggttgcaaatagagtcgcaccccttgcggatgcatcaggtactttgaggattactagccgcggaagtctcgtccttctcaacgggaatggaagtgatatctggtcgtcgaactcgacaatactggtgcgtaatccagttgcacagctcttggattcaggaaatctggttgtgagagatgcagatggcagtgatcccaataatgtcctgtggcagagttttgactatcctacagatacatttctagccggtatgaagataggatggaatagaacttcaggcttcaatcgttatttaacatcatggaagagcattgatgatccttctccgggcaacttcacgtatcaaatcgatccgaacggctacccacaactcctactgaagcagggttctgacatcaagttcaggtcaggaccatggaatggtcttcgatggagtggcacgcctaatttaaatccaaacccatactacaggtacgaatttgtcttaaatgaggaagagatgtactaccgctacgagctcctcaacagttcggtcattaccaggaagttattgatgcccaatggcatggtacagcgattcacttggattgaccgaacacatggttggacgctttacctcaccgcgccaatagaccaatgtgacaactatgcatcgtgtggtgcctatggtacctgtagggtcgatacttccccagtgtgtaggtgcttgaaaggcttcgtgccccgattttctcaagaatgggatattttggattggtcgaatgggtgtgtgaggagaaatcctttggattgtgaaaaggacatatttgtgaagtattcttgggtaaaattgccagatactcggtcttcctggtttaatgagagcatgaatcttcaagaatgcaaagtagtttgcatgaaaaattgttcctgtatggcttattcgaacttagacatccgaaatggaggaagtggttgcttgctgtggtttagcgagctgattgacattagagagtacaacaactatgggcaggacctctacatccggatggctgcgtcagaatcagctttactaccgtcaccccaaaagaagcataagctggtcatgggcttggcagtttctttcgggtctgtcttcctcattctggtcctcatcatctgtgttcgacaatgcaagaagaagaaaatggagattcctgaaggagacaactgtgaaaaccagaagaaagaccttgagttgccactatttgacttgtctacagtagctcttgctaccagttacttttcaaccgacaataagcttggagaaggtggttttggacctgtctacaagggtgtgttgaggggtggtcaagaaattgcggtgaagatgctgtcaaggaactcaagacaagggctgcatgagtttaaaaatgaagttctatatgtttccaagctacagcaccggaacctagtgaagcttctaggatgttgcattgaggaagagaatattttgatctatgaattcatgcccaacgggagcttggactcatttctctttgatccaacgcagagggagcaactggactggtcagcttgtttcaacatcatcaatggaattgctagggggcttctttaccttcatcaagattctagactcaggatcattcacagagatgtgaaagctagcaatgtattattagattatgagatgaatcctaagctctctgattttggcctggctaaaagcttcacagggaatgagacacaggcaaatactaacagagtggttggaacatatggttacatgtctccagagtatgctcttgatggagttttctcaacaaaatctgatgtctttagctatggtgtattggtgcttgagattgtaagcaggaagagaaacagagggtttcatcatccagaccacgatcataatcttcttggacatgcttggagactattcacagaaggcaggtccatgcagttgcttgaccagttggttgcgaactcatgcagtacttctgaagcattgcgctctattcatattggcctattgtgcgtgcagcaatgccctgatgataggccgagtatgtccactgttgttatgatgctaggaagcgacatcgaattgcctcttccaaaaaagccagggttcttcaatgaaaggaatctactccaagaaaactcttctcaaagtcaaccaaattaaatgaccatgacagtgttatatgctcgataagagagtcatggccatgacttgcattctttctctttctgtgagccatacactcccgtgtggaaaatcaaagtaaaagctcttcaatgtcgtcctctagctatacttccaaaaataccgcatctctcatttggctgcaggttcaatgtgcatggaatgtctttagatctataaaaaaaaaaaaaaa

SEQ ID NO: 874 - DNA, 2315 bp, Eucalyptus grandis
gtggaataccttaagtttctattcatactagagactcacttcacagccaagagacgttattgcagagatttatcattctatctgcaccatcacttgcttcaagcagatttggactaatctagccttagcccatctgggttttctgtgcttctgatgaatctcaatacgatgagactgaagagaggtgaagaagccgctttgtgtttagtggccttcttgtggatttggaattcggcaaatggattgctctctcccaaaggtgtgaactttgaagtgcaagctctgatgcgcataaaggactgtctacatgatcctcacaatgtgcttgagaattgggataaggatgctgttgatccatgtagctggactatggtcacatgttcaactgacagtttagttgttggactgggaactcctagccagagcttgtctggtactctttctccaagcataggcaacttgacaaaccttcagatcgtgctcttacagaacaacaacataatggggccgcttcctccagagctcgggaggctttcgaggcttcgcactctcgatctttccaataatttcttcaccggagaaatcccctcctcactgggtcatctgaacagtcttcagtacatgaggcttaacaacaatagtctctccggtgcattcccgagctctttggccaacatgactcagcttcaattccttgatttgtcttacaataacttgagtggccctgtccctagaattctggccaaaacattcaacattgttgggaaccctcaaatatgcgcaactggcaccgagccggactgctatggaacacagctgatgcctatgtccatgagcttaaatacttctcaaacgctaccctccagcaaacgtgaaaatcataaagtagcctttgccttggcatcgagcatcggttgtgtctgtctcatcattctcgcctttggcatacttctttggttaagacaaaggcacaaccaacccacattctttgacgtcaaggatgggcatcatgaggaagcttcgctggggaacttgaggaggttccactttagggaacttcagattgccacaaataatttcagcagcaagaacattctcggcaagggtggctttggacatgtctacaagggtgttcttcaagacggcacgctcgtcgctgtcaagaggcttaaagacgcaaatgctgttgggggtgagatccaattccagacagaaatcgaaatgatcagcctagcggtgcatcgcaacctcctcaggttatatggattttgcatcacgcctgcggaaaagctccttatatacccattcatgtccaacggcagcgttgcatctcgcctcaaagggaagccggtcttggattggggcaccaggaagagaattgccttaggagctgcacggggattactgtacctccacgagcaatgtgacccaaagataatccatagagatgtaaaggcagcaaatatattgcttgatgactattgcgaggctgtggtcggagatttcgggctggctaagcttttggatcaccaggactcacatgtcaccacggccgtgagaggcacagtgggtcatatagcccctgagtatctctccacggggcaatcctctgagaagacggatgtgtttgggtttgggattcttctccttgaattgatcactggacagagagcactagagttcggcaaggctgctaatcagaaaggagcgatgctcgattgggtgaagaaaattcatcaagagaagaaattggaaatgcttgtcgacaaggacctccgaagcaactatgatcggattgagctcgaggaaatagtacaagtagcactcctatgcacccagtaccttcctgctcacaggccaaagatgtcggaagtggtccgaatgctcgaaggtgatggcctcgcggaaagatgggaagcctctcagagagttgaatcgaacaaaggcaagcctcatgagttctcatcgtcagacagatattccgatctcaccgatgattcttccttgctggtccaagcgatggagctctcaggccctaggtgactatggttctttttcgaagaattgacaaaatctatagttttggaaacggaggaggttgaaacagcttgtagctattgcatatagagaaaatgaattcatgttggtgacctttcgcatacctgagttaaatggggtaaacattgtaaggaattacatgagagatctgagagctatctggaatgtgtgagcacaagatgagtatttgtatttgtattatagtcgttccaatatatgtcagctccaaacggcttcagtgttaaaaaaaaaaaaaa

SEQ ID NO: 875 - DNA, 1686 bp, Pinus radiata
gttcgctgagagctgtagagtgatagtagtagtagcacagcttcgatgggtggcctgctgcatttgactgtgttggcagttgcagtttttctgatggtttctctgagccagtgtgggtttgagctgaacgatgaagtgctgggactcatagttttcaaggcagatttgcacgatccaaaatcatccctggcttcttggaacgaggacgataacagcccatgttcgtgggcaggtgttgtatgcagcgccaaaacaggaagagtcacagaagtggtgctcgacaatctctctttatctggaaagatcggcagaggtctcactaggctcccgtcccttcacacgctctcacttgccaacaacaatttctctggcgatatcaatatcagtgcagatctggcccagattcccagcctcaggatcatgaatttgaatcacaatgcgttctctggtgcaattcctgcagagctctttcaacaatgtgatactctcagagttatttccctttcccacaatgcgttgcaaggtgcccttccttctagcctgagctcttgttccagtttgacagcattgaacttgtctgcaaaccatctgtctgggtctttgcctgggtcaatttggtcgctgaaaaatctaagatcactggacttgtcccacaattccttttcaggagctgtgcctgcgggtattgggggtctcagtagtcttcgagagattcatctcaacaataacaacttttctggccctttgccagctgatttaggtgactgttctcttttgaggaatttggatttcggccataacttgttttcaggtggcctgccagattccccgaaagggttgaattttgtttcagctatgagctttagcactaatatgtttgtgggaactatcccttcgtggataggaagcttgagggtcctcgagtctctagatttgtcaagtaacagcttcactggagagcttcccaacttgtcttccctgcagaatgctaggctcatcaatgtgtcatataataatctctcgggacccatcccggaatctttactgggctgtagtaggctttactcggttgatttcagcaggaatggctttactggaagcattcctggggagttgtttcagttgggtttacagaacatatatctgtcatggaattctctcacagggagcgtcccgcaagctggttctccaaaactataccaatttctggaagaactggatctgtcacacaataggttgagtggggaaatacctccatcaatcactcagtgctccaatttaaagcgattgagcatgtcagataaccttatcgcctccaagattccgtcagagattggtaatttgaagtcgttggtgtttttggatctgagctataaccatctgtttggagccatacctgcgagacttggtaatgccagtgctctttcagtgttgcaactggatggaaattccttatctggacgaattcctgcagaaattggtgaatgttcatctctggttttgctgagcttggcacacaatagtttgactggaaatgtacccaaggaattagccaaattgagtcgactgacaaagcttaatttggcaatgaacaactttaccggagaattgccccagcaattaggaaacttgggtcatctattatcggtaaacatttcccacaacaaacttaaggcaggttaccag

SEQ ID NO: 876 - DNA, 1744 bp, Pinus radiata
gtctaagattaagaaataaatctcgcttgggactgcagccacttgttacataattagcttttgtatgtaaattcaattcattcggctacactttcgtcttctatgaatcagtggccatctgtctaaagctttggttccagcctgccatttgaactttctaaaatccctgtgagcatggacaaaattccttatggcgaatggtctcgctggatcgcctttggctcgtttttactggttgttaatgttatttctgaaccagagggatttttgagtatcacttgcggaggggaaatgaatacaacccacaacggcataacatgggtcggggatgctcattacatagacgtgggtaacacggctgagataacggacctctctgaaaacgcttacggttcttacttacacactatacgggttttcccaaagcctctcaacaaatcttgttatcagttgcctgtggttccagatgtgccatacctcttaagactatggtttgcccttggaaattatagtggattccaacaatggccaagcttcactttctctgttgagacgctcggtttgttggcttcacagaacgtatcattcacagatacagataccgatatatattattacgaatatgtattcgttagttctggcaaagtgctacatatctgcttcatcagaacatctgaccctgatgatccctttatcaacgctatcgagttgaggactctcaaagtcggcatgtatcatgcagcggctaaaccaggaacactcttgcctttaacacgaagacagaatgttggtggttcgacagtaataaggtatcctggcgacaacttcgaccgcatctggacaccacgaactcctcccaccaataaaaatcttgtggtggctgtaactaccacacatcccatttcatccgacaataccgatgattttcctccctatgctgtcctgaaaacggcgtgggttgtaaacagctctgaatcgaatgacattatatttcatttaggttcggtcctagggaagaaaacaatgttgttactgtattttgcagagatcgagacactaaataagcccgaatccagatccttttctgtcaagataaatgacgtatatcgaacgcctgacatcgtttcattggtgctaaattactctgctgtagagcttgctttccaaactaatgatatttcgacatctgacttcacatttgcgctagacaaggccaatagctctacccttgcacctataatcaacgcttttgagtattactgggtgatcgatacgcaaccgccaacatattcaaaagatgttgaagcccttatcgccatcaaaagtaaatttggcataataaattggatatccgatccttgctatttgatccactgggaaggaattagctgtgacaacagctcttccgacataagaatttcggaattgaatttgtcgggagggaatctcacgggatctatacctgccgatattggacagttgacagcattaattaacatgtcacttgacaataattatctaatgggatcgttgccgaatttctctaatttagcattcttagagcgattgtatctacaaaacaacaaccttagtggtagcgttccggagtggctatctgaactcaaaaaccttaaagagttgtttatagaaaataacaatttcagcggtgtgattcctgcacaacttttcaacaaacttatcaacaattcattgaaaatgaactactctggtaaccctaacctat

SEQ ID NO: 877 - DNA, 1024 bp, Pinus radiata
cggacatggttctctgatcccacttcagcaaatttcatacttttgccatcgttgcagagctcttccaagatgggtaacagacaccagatgctgttacttctctcttcttttcttcttcttgttgctgttagaacagaggcccaggattcccaacccaatatcacaggctacacctgcaccaacagctcatcgacctgtgagacatatgttttttatagagcccaagctcccaattaccttgatctcctaaatatctctagtttattcggggtgcaaagagtccagatagcaaccaacagtaacttgtctactaccaccatctccgtagccgatgggcagtcattgcttattcctataacgtgtggatgcatggggaattactcgcaggcaaatatcacctacacaatctttcagggcgacacttactataaggtttcaactgggaattttgagaatctgacaacatatcaggctgtcgaggttgcaaatcctaccctgaacccaacagaccttcaaattggggttcaagtcatcttcccaatcagatgcaagtgcccatcacaagcccaagtgaagaatgggaccaagatgctcatcacatatactgtgcaaccagtagatactcataatctgtcaagtatcaccaagaagtttggctcagatctgcagaatttcaaatctctgaacggtatgaattcaaccctaactgcctatactacagttttggttcctgtttctcagagacctgtgctttctcaacctgtttcgtcttccccacctccacctccacctccacctccacctgcagctacttcgggaaataacactacttcgggaggtgggtcgaataagggtgttgttattggggcttctctgggtggggctgttgcacttgtttgtgttgctctgttagtcttttgtgttctgaggaacaggggccggtcacataaacaaactagcatatctgaaggtccaaagccgcctgtcccctgcgatagagaatactaaaaaaaaaaaaaaaaaa

SEQ ID NO: 878 - DNA, 3432 bp, Pinus radiata
gttttcgtagagcttgtgctattttggtgctgtgaaaccgagagagatgaggagatcagaggcttgaggtaggagaagcgtgtgttgtctttgcttgcgtgtagcctgcattgaagtggaaaacttgaagccgtggacgtgaaaatgtcacgggctggttacctgcattttctgtttttctgttttgttctgacagtaagaagctgcttcgctattcgcggttggcaggacgggcttattttgcaagaattgaagcgcggattcgatgatccgtcaggagcgttcagaaactggaatgagaatgataattctccgtgtaattggacgggaattacgtgcgatgccggcgaaaagttcgtagaagaagtcgatctttcgagcaagaacatcataggaccgtttcccactgttgtttgcagaatcgatggcctcaagaagctctctttggccaataattacgtcaatggttcaattcctgcgggcttgagaagatgccacggcctggagtatttggatttatcgcaaaatcttatcatcggcgggcttccggatttcatctccgagctcttcaggcttaagcatctggatctttctggaaataacttaagcggtccggttccccctgcgttcggccggctgccggaattgcaagtcttaaatctcgtctctaatcttctcaatactacaattccgccttttgtaggtgatcttccaaatcttttgcagctcaatttggcctacaatcctctcactggaactgtacctcctgagctcggaaatctgaagaagctgcaaaatctatggctggcgggctgcaatctcgtcggagaaattccggagaccttgggcaatctctccgagctaacaaacttggatttatcgatgaaccgtttgtccggttcgattcccgagagtatcacgaagctggacaaagttgtacagatcgaactttaccagaaccttttgtcgggtcccattccggtcgccatgggcgagctaaaagcattgaagaggtttgatgcttccatgaatatgctagacggttcaattcctgccgggctggggagcctgaatctggaatccctgaatctttatcaaaacaatctggttggcgaaatacctccaggcttgggttcgtttacgagtctcaaggagttaaagctcttctccaatagtttaaccggttctttgccggagaacctcggcagaaattcggatcttctagcactggatattgcagacaacctgatatccggaaggcttcctccggatctatgcaaaaacaaaaagcttgaaattctcagcattttcaacaatgagctcggtggtaatttacctgaaagcttgggaacctgcacgagcttaaacagagtccggctaggaggcaacaaatttaacggctcggtacccagtttattctggggacttcctcacgtctcactgctggagctcaaggacaattattttgaaggatttatttctcccgacattgccgacgctaaaaatctctcatagctcgtcatcagcggcaatatatttagcggcagcctgcctacagaaatcagtgagctacggaacctcagcgagataatcgctagcaataatttactcactggtgctttgccttccagcttggggaagctgcaactgctcggaaagctggaccttagcaataaccagctaagcggcgagcttcctgctgaaatcagttcgtgcaaacagcttggagagatcaatctttcaaagaaccagctctccggttcgattcctgccagtgtcggtactttgcctgtgcttaattatttagatctctcggacaatcttctcaccgggccgatcccttccgagctcggtaatctgaagctgaataccttcgatgtctcggacaaccgtttgtctggcgcagttcctttggcttttgaaaatccggtgtatgaaaagagttttctgggaaatcccgagctgtgtagccgcgaggcctttaacggcaccaagtcctgttctgaagtacgtagtgaaaaggctaaacgccagcgttggtggtggttgcttcgttgcttgtttgcattgtctattattattttcgtccttggactcgcgtggttttacagaaggtaccgaaactttgcaaatgcagagaggaaaaaatctgtggacaaatcttcgtggatgctgacttcatttcacaggttgggattcagtgaatacgagattctggattgcttggatgaagataatgttattggaagcggcggagccggtaaggtttacaaggccacattgagcaatggtgaattagtggccatcaagaggctttggagcaatggtaaaaccaatgcttccactgataatggtttccaagcagaggtggatacactggggaagatcaggcataagaacatcgtgaagctatggtgctgttgtagtaagagtgattccaatctgttggtctatgagtacatgcctaatgggagtctgggagatcttcttcatggacctaaggctagtgttcttgactggcccataagatacaagattgcccttggagcagctcaggggctggcatatcttcatcatggttgtgtaccatccattgttcacagagacgtgaaatccaataatattttgctggatgaggattatggggctcatgttgctgattttggtgtcgcgaagtttctgcagagctgcggtagtggagctgattctatgactgcaattgctgggtcctatggctacatagctccagagtatgcctacactctcaaggtgaatgaaaaaagtgacatctatagttttggagttgtgatcttggagctggtaactggcaggcggccagtagatccagagtttggagagaacaaagaccttgtgaagtggctgtgcaataagatagagacaaagaatggattgaatgaagtgttggatcccaagcttgtagattgcttcaaggaggaaatgactatggttatgaaagtagggcttctctgcacaagtgtcctgcccattaacaggccatcaatgaggagggtggtagagatgctgcaggaagccaaccccgatcacaaggccaaggcaactgccaaggatggaaaattgtctccttactattacgaggaacccaccattggcattgtataggcatgatagtaattgcatttggcctggacttttcttcttcggcctctgtatttactgctactttgtagcttctgcgcttgcttagctcttgttcatgtgaaactttaaaatcttactctgatagtgttacccaaaagaagcttccccctgtaacttttagggtatatttacaatgagaatagaatgggtagaggctcatgaatgaagaggaacacgtgtctacccacttgtgggcctttgtaactttgtttttcatagatctgccttttgagtcaaaaaaaaaaaaaaaaa

SEQ ID NO: 879 - DNA, 2509 bp, Pinus radiata
gcttctcttgctttttgcctccaaatcttcgcttgcattgggaattttcccatggcacctcattcccagctcgatgccttgaaaaagaacaatgaaaagcttccgaccagagcctttgagatgtagccttataaacaaatatttgcaagtacgggagcgtttcaagatctgttgtcttgcaaaggtgaatcagaaaaatgggctcttgggagcagtccacagtgccgagcattgcatggaagctattcatcattgtgctgctgctgattttagtggaagatcatgcagtggttggtgacaatgcttctgataaaaaggccctcttggctttcaaggcagcggttgggaagcgtctgaactggtctcagtccacaaatccgtgcaccccctggttcggaattacgtgtgtaggatccagtgtgacagaggtgagacttcctggacggtctctgtttgggtcaatcccatcgggaattctgggaaacttgagcgagttaagagtattgagcttgagatacaactcgctcaatggtcctgtaccttcagatctaggtaagtgcactcagttgaagaagctgtacttacagagcaatggatttaccgggcccataccatcatttttttctacgtttcccaatctagttattatgaatctggccttcaacaggtttagtggccctattcctagctctctgagcaatttgcagaaattggctactctgtatctagataataattctttaaatgggtccatttctgcattaaatccccccaatctgcagcaattgaatgtatcaaacaatcaactcagtggatctgtgcctcccacactgcaaaagttccccgcgagttcatttctcgggaactctttgtgtgggtctcctttgctatcttgtgtaggcggtgttgccccatcaccgaatccttcaagtgggcacaaaggaaaaaataagctgggggcttgggccattgtgggtattgttttaggatgtttagcttttctagttctcttattccttatcttgtttttttgcaagaggaagaaaaaaagggaaaatccgagagtggttgagtttgccccaggcatcaaggcccctgatgatgcaccagaggacacaattcccaaagaggattttccagctcctcctgtgcaggaagttgaaaagaatactagtaaaaggctcgttttctttgaaggtagccagaggacatttgatcttgaagatcttcttagagcttcagccgaggttttgggtaaggggagcgttgggactgcttacaaggctgttttagagtttgggttagttgtggcagtgaagcggttgaaggatgttgtaattgggcagaaagaatttgttcaacagattgaacaagttggaaaaatgcaacatgaaaatctggtacctctcagagcttattacttttcgaaggatgagaagcttctcgtatatgattatatgacaatgggcagtctctcttcccttctgcatggtaacaggggagcaggtcgaactccgttagactgggaaacacgctctcgtattgcccttggtgcagctagaggcatcgagtatctacatagtagaggcagagaaatttctcatggaaacatcaagtcttccaacattcttctcaccagggactataatgccggtgtttcagattttgggcttgctcagttagtgagttcaactccatctgccaatagaattgtcggatatagagctccagaagtcaccgatgctcgcaaaatttcacagaaggctgatgttttcagctttggtgtattgcttttggagatactgactggaaaagcaccttctcatggggccaatgatgacggagttgatcttccacgttgggtgcagtccattgttcgtgaggaatggacagcagaagtgtttgacatagagcttctaagacaccataactttgaagaagatatggttcagttattgcaggttgcaattgattgtgttgcacaatatccagatcaaagacccagcatgaaggaagtagtcaaaaggattgaagatttgaggcgaaatattgaagatgatgatggccctgaggatctatccagttctgcagaaattcctgattgagggacaacgtcagtgataaagattaattagaaccaggcattgccaatatgtcaaagcttgtttggaaccattttttctttgtgacttcagttggatttcgtcatgttgcagaattgctctgttgattttattatttcagttatctgcaggttgccagaatatgttagagtgttttccttctcccatctaaatctgtttcaccccattttcccttttagataatggaaggatattggaatgcttggcaaccttttgggcagtgcccaaaggaagctacctgtgtctcatctcagtagcagctgcttaatgattgtagcatctgctggtttttgatttttttacttcgtcaatgatttttgcaaaataattgattagaggttgaaaaaaaaaaaaaaaaaaaaaaa

SEQ ID NO: 880 - DNA, 4017 bp, Pinus radiata
ggacattttgttagtaccttggcggacggattcttttacaggtgaaattgggagcatgatccgggcctatagattgtactctctgatgaaagcggatgtttgtgaatcgtattcggttacattgctaaagcctcctctgcagcagattatacccaaaaaatcattggggtttcatgttgttgtatgggccctctgaaactccatggccttggagcaactaatgataaggatcagtgatgtggggacgaaataatggaactcctgagcattttctgcttttgtgaggtactaaaattctgtatgattccattgcgctgaaaccaagaactctgtctgtctgatcaggctgtatcatggcctacaagcttttgagattttggcttgaatttcaggccttactagtcctctttccattggctctgagtgtctctcaggagggcttggttttgctggaagtgaagaaagaactgagtgaccccaatggatttcttggtaactggaaggcagaggacgattctccctgcaaatggaggggtatctcatgcgaccagaggtcaaaatcggtggtggggattgacctaagcagcggaggtttagttggggtttttcctagtgtcgtttgcaatcttccacagctgaaaaatctgtcgttgggggataacaatattggctcaatattacctcgcaacctttccatgtgcaggcagcttcagcgcttgaatttatcgcagaatctttttgtggggaaccttccggactttatttcagagctcgcagagctggaatacttggatctctcgagtaacaatttctctggttcgattcctgcaggcattgggaaactgccaaggcttcaagtactgaacctgtgctgcaatctgctaaacgagacaatcccaacatttctgggaaatctcagcaatctgcagcaattattgctggcatacaatccctttgcccccggtgtgattcctccagagctggggaagctagcaaagttacagaatctatgggctacttcttgtaattttgtgggtgctattccggattctattggcaatctgctgtctttgacgaatctggatctttcttcgaatcagctctcgggaattattccagaggccatcacaaagttaaatcaaatagtacagattgagctctatcataacaacttaacaggaaggattcctgagaactgggctaatcttgtttctctcagacattttgatgtctcaacaaatatgcttaacgggaccatacctgagcagttggcaaggttgccactttcgtccttgaacctgttcgagaataatttggtaggcaccattccggaggctattgggtattctccaactctgtctgagctcaagctgtttacgaataacttgaatggtagcttgccttcgaatttggggaaattttccggcctacaaacgctagatattgcaggaaatcgactgagtggtactcttccgccggatctttgcaagtatgggaagctgcaaactttgaatatctttaacaacaacttcactgggcagttgcctttgcaatacggtgcatgtttgagccttcaaagggtgagaataagccacaatgagctcatgggacaagtgcctagttcattctggggtctccctcacgtttattatctcgaactcagtaacaacaagttcgaaggctcgatttcttctgaaattaggaatgccaagaatctatcagcgctattgatatccggtaaccgtttctccggcaccttaccttctgagatagggcttgtggctaatctttctgtaattgatggtagccacaatcaattcacaggtcctcttccagccactttgggttcgctgaacaaattgagtaagttgcatctcttccagaatcagttctccggtagccttctcactgacatactgtcatggaatgagcttacagacctaaatctgtcaaataacagattctcgggccctattcctaaagagctaggggagctgccagttctgacatatctggatctttctgttaatgccttgacaggagaaatccctcctgaattgggcaatttgaagcttaacagtttcaatctttcggataatcagctaactggcattgttccttctgctttcagtctcagtttttacaagtcaagtttaatgggcaatcctgggctttgcagcaatgatggtcttaaagggtttaagtcctgttctgacatggagaatagcgggagaaaaaagtgttacagttgggcatggctgctcccagcactgtttgctttggctggggtcatttttgtgttaggactggccttgttttatagacaataccgtgaatacaataaagctaaagttaaagatttgtggcgaagcaataagtctccctggatgctgaccacgtttcaccgattgggtttcagagaatatgaaattctggattgcatagacgaggaaaatgtgattggaagtggtggatcaggaaaagtgtacaaggccacactcgggaatggagaaactgtggccatcaagaggctgtggaacaatggaaatgctgaaggctctacatcctgcaatgataatggattcaaggcagaagttgaaactttgggaaatattaggcataaaaacatagtgaaactctggtgttgctgtgtcaatgacgattctaatcttttggtatacgagtacatgcctaatggcagtttgggggatctccttcatggccccaaagctggtgaccttaattggcctacacgttacaaaattgcagttggagcagctcagggtttggcttatttgcatcatgattgtgtacctcctatcatccatcgcgatgtgaagtccaacaatattctgctagatgctgattttggtgctcgtgtggctgattttggacttgccaaggtccttcagagctatgagaagggaatcgatttcatgtctgcaattgctggatcctatggttatatagctccagaatatgcatacactctcaaggtgaatgagaaaagtgacatctacagttttggagtggtgcttctagagctagtgacgggcaagcagccggtaattcaggattttgaggagagtaaagacgttgtaatgtgggtgcgcactagaattgagaagcaaaatgatgggttacaggacatactggattctagagtaatggtagattgcttcagggaagaaatggctgcagtcctcaaagtggctcttctctgtaccagtgctttgcccatcaatcggccatctatgaggagagtgttggagttgctgcatgaggctggccaactgcacaatgttaaggatgttgttactaaggatctaaatctatttccataagctttttttaggcataactattaatggacaccaagtattaagatccaacgacatgttctggctctgaatgagcagttgggcatgagttgatctctagaagatccctgcaattttcttttctttttgttgtgtgcattctagaagttcctatgactataaaactcctcttttctcacacactctctcttctcagagtgcatcttgaaatagtttctgcttctttcaaagttcctcttccctcttttttcttgttatggtatggatcttgaattgctttctaccattaagagagcacatctctcttttttcaccatagaagttctatatattctgtcttaaacgtgagctgttgcttagttctgtacttttgccaagtgagaagtacttggcttttgtaaaacaaattagagaaagatgtagctgtagttctctagttttgccaagtgagaagtacctggcttttgtaaaacaaattagagaaagatgcagctgtttaattctgtgcctatttgactgtgaaaaatgaaagctaatgtgcttcaatggcagaaagacaattatgttgtacaccattatatagctttgtattatgttgaaggctttatgcttgagaatcaagttatttcctgaacaacattacatttcttatgtcaaatgaaatagttataattct

SEQ ID NO: 881 - DNA, 2637 bp, Pinus radiata
ggcagttggagtggtagagtgagaaatacacagcctaatctgaaggaagttcgagtaatagactgagaaatggatcttcttcttctcctcatcatgatgcttgtgatgatgggtgtagcaatgcctactcattctcaacgttttccctttaatggatggagtatgatggggaaaccctctctgttcccatcctccatagccgggtatcatgaaaaaagggatgtggaggcacttctgaccttccggaagggcatcacattggatccatatggatggctctccaactggacggccaataactcacataacgtctgcctgtggaacggaatttcgtgcagcccaaacacgaatcgagtggtttcaatttctctccgttacggccggttgaatggtacgctctccccgtatattgggaacctctctcttttgcggcatttagatctttcttcgaatgctttgagtgggagaattccagcagagtttgggcagctgaaagcgctacgaatacttgacctctccagtaatactttgaccgggagtataccaacttgtatcggcaaccgcgggttgaatggtacgctggatgtagatctttcctggaatgctttcagtggaagaattccaaacgaattgtttaattgtacacgtcttcaacggatcgacctttcccataatagtttgacagggagtataccaacttctatcggcaactgcgctttgctccaaaagttggatactggattcaactatttgagtggaagcatcccagcagaactcggtcgtctggtccacttggaatctctctggttggagagcaatgctctgagtggaagcatcccaacttctctcgccaactgcacttcacttacagatttggttattagctccaacaatttgagtggtccaataccatcagaattcagtcgcctggtcagcttgaaatttctctggttcgaggacaatagtataagtggaagcatcccaacttctctggtcaactgcacttcgctcttttccttaaagggtagcggaaacaaattgagtggtccaatcccttccgttatgggtttgatgaaaagcatatctactattgatttatccaacaactctctcactggccacatccctcccaccctattcaattgtactcagctatatgagttgtacctaagcactaacaaccttagaagtagcattagcattccccccagtattaccgatacggatttggtttatctcgacttatcaaacaaccagttaattggatctctccctcgtaacataggtcaattaagcagtcttcaatctctcgttttatcaaataacaatttgactggatctctctcgcataacataggtcaattaagtgatcttcaactccttgatttatcaaataacaatttgactggatctctcccgcttagtataagtcacatagaggatttacaagaactagatctatataataataatatttttggcactatacccaatacaattagtttgacttcccttcagattttagatttatcaaagaacaatttagatggatcaatccctgaacttaatggtagttgctcccagttaagttttttctctgttcacactaataaactttttgggactttgccaatgtttttggctaattgtattgaaattcagtatttagatttaagaaaaaacaatttgacagggcaccttcctcactatttgaaatctttttcagaattgttaattttaaactttggctataataattttcatggtggcattcctgaatgggtaacaaatttcacctatttgtatgtattggatttatccaataacaaatttagtggaagaatgccattacattttgaaagggttcaaggatttgtaaattcttcaaagaatgatgactttgaagaaaaagaaatcacagttcacatgaaaggatgtgagtatactctgccatacatctcatcagaaaacacaatacttgatttgtccaacaataatcttgtaggacaaatacctgcaagcataggaactttgagaaacatgcgattgctaaatttatctggcaaccagttggaagggctaatccctgcatctcttagcaacatatctactttggagcagttagacttgagcaagaacaatttgagtggacatattcctgaagagctctctaaactatacagtctggctgttctggatgtttcatctaatagcctttgcgggccaatccccggaggaacacaattttccacattcagtgcaacatcatttcaaaggaataagtgcttatatggctgtcctttagattcatgcagtgaaaaggaaaacccattgggagaaggtgacaataatagtagcagtgcccatatgaaaatgggatggcttgagcatttagatgaaaagatgtcattaatggcattggggatcggttttggtattggaatttggggagtagttggtgtatttatcttttgcaacagagctagacactgggtgttgggtctaccacctaacaaaccacaactcttctatggaatgtatcaattccctacataaagaaccaagtaatggatgttggctctagtatgtggtgaattaaattgtcatgtaatctaccaatgatatttttggtacccg

SEQ ID NO: 882 - DNA, 3367 bp, Eucalyptus grandis
cggctccttttcttggtcctttaaaataaagagaaaaagggcttcgctccactggccctctctttctccctctgtgttctttttttaatccgaacgttgctgacaaacggagtggcttttctccgttcctttcttctgggcaatttttcctctccctctcgcctctctgggactcgcgggagaagatacggatatgggaagagggctcttcctgggaagagggctcttcctgtgcttgctcgtcttctgcacttcagttcttatggagctctccactgctcagatgccaggttttgttagcttggattgtggaggatctcagagtttcactgatgagattgggcttgaatggactccggatgaccatttcacctttggagaaagaactaacgtttctctcacgaatgagacaagaacacaatatacgacattgagatacttcccagccgatgacagaaagtactgttacactttaaacgtgaccactaggacaagatacttaataagggcgacattcttgtatggggactttgacagcaataacgtctacccaaactttgagatctccttgggacctactttttggtccacaattgtcatttctgatgccagtactatagaagtgcgagagctcatatttctggcctcagatcctaccataagtgtgtgcttatctaatgctaccacgggcaacccattcatatctacccttgagcttcgtcagttcaatggttcgatgtactttactggctttgaaaaccagttctatctcagtacctctgcccggattaattttggtgcagaaagtgaagagccagtcaggtatccagatgatccattcgatagaatatgggagtctgactctgtaaagagagcaaactaccttgtcgatgtggcctctggcaccaaaaaggtttcaacccaattgccaattgatgttaaccgtgacgagaggccacctcaaaaagttatgcagactgctgtagtcggaacaaatggatcgctcacttaccgtttgaacttggatgggtttcctggtaatggttgggcatattcctactttgcagaaattgaagatttggctcccgaagacacaaggaaattcaggctggtgctcccaggcgcgcctgatatcagcaaagctgttgtcaatataatggaaaatgctcaaggcaaatatcgcctgtatgagccaggatttgagaacctaaccctcccatttgtactgtcctttaggtttgggcggacaatagattcttcaaagggtccactattgaatgccatggagataaacaagtatgtgaagaaaatcgatggttctccagatggaggagttattgctagcataatttcaccctatacctcagcagcttgggcacaggaaggtggagacccgtgcctgccagttccatggacatgggtgcactgcagctcagattctcctccactgataactgcagtgtatatgtctacttcttgtgatgtgcttgtgtgaacacattttcttattctaggagcatgtcaacgctgtatgaacgaccgagttttgaagttataaattgtatttctgcagcaaattgtctggtcagaatttgaccggaaacattccttcagacattacaaaattgagcggcttggttgagctgcggctcgatgggaatgcactcactggttcaatacccgatctttcttcatgcgtgaacctggagatcattcatcttgagaacaaccaattgactggtgagctgccttcttctctcgcgactctgccaaagttgaaggaactgtacgtccagaataacaagttatcaggcacagtgccatctggtcttctcaacaaaaaattgaatctgaattacactggaaatatgaatcttcatgaaggagggaaaagtggaagccagactaagattatcattggttcatcagtcggagctgctgttctcctggtagccacaattgcctcctgtctcttcatacagaaaggaaagaggaattctaagcatgatgacaatgtgcaaatattgccgacgcagcggctagtttcttccttgagtaatgctcctacagaagctgctcattgctttatgctatcagaaattgaagaagctacaaacagatttgagagaaaaattggttctggaggatttggagttgtcttttatgggagactgatagatggaagagaaattgcagtcaaggttctgactagtgattcctatcaaggaaagcgagagttctcaaatgaggtgactcttctttcaagaatacatcacaggaatttggtacaattccttggatattgccaagaagacgggaaaaacatgctggtttacgagttcatgcataatggaactcttaaagagcacctatatggtccattgcctcatgagtggaattttaattggatcaaacgccttgagattgctgaagatgctgcaagagggatcgagtaccttcacactggatgtgttccagccatcatacatagagatttgaaaagtagcaacattcttgtggacaacaacttgagagcaaaagtttcagattttggtctctcaaaatctcaagttgatggagtctcccatgtctcaagtgtggttcgaggaactgttgggtatctggaccccgagtattacatctcccagcaattgacagataagagtgatgtctatagtttcggcgtcattcttcttgaattgatatcaggtcgagaagcaatttctaacgaaagcttcggtgtgaactgtcgcaacatagtccagtgggcgagactacacatagagagtggggacatccaaggcatcatcgatccgaacctacgtgaggactacgacatccagtcgatgtggaagatagcggagaaggctctgatgtgcgtccagccccacgggcacatgaggccatcgatctcggaggttctcaaggagatccaagacgcattgttgatcgagagagaagccttggcggcgcgagagggcctgtcggatctgtcaaggaactcgttccactcgtctgtcaacatggatgcctttgatattcctgggactgagaactacgtagcgatcgacgagtctattgcgcagccaactgctcggtagagcttcatcttctctttcttttaattccttgtaatatttcctgttcattcttgggagcggctggtgattgtattccttgttgtctggggttaaggtgaagtatctggtgatcatgattagaattgcctgcctagttgatctaccccggtgaaccgtggtgagatctctttctgtcggttggttatatcaagatatgtgctagctagcccagttgatacgcttggttatataaagataagggtttagcccagaaaaaaaaaaaaaaa

SEQ ID NO: 883 - DNA, 2586 bp, Eucalyptus grandis
tgtagaaccaccccaacatgagattaccaagcttgtcgcaccagcaccatttcccatggctcacttcctcgggaaactccgctccctgctcagcttgatcgtgtccttgtccttgttcttcttcttcgcgcttccattcgcttctccggtcgcctcgctctcgaccgtgtcgatcaccgaaaccgcgaaccggacgttggtctgtgctcttataaagacccccggccagaccgtgtttctcaactgtaccagcttcccggcaggaattcaaattcctgctaatatcgatgcttccttcacgggcatcgtcggcggggacgggttcctctgcggcttgagaggtaagtatttttcgaccccgtcatccctggtttgctggagatactccgccaatggcaccgagtacagctacaggcgcatctacaggggtcctccggtgacagagctcgattccggagatgctcacgtgtgtggtcttgccaatgggactagccggctcaagtgctggcagtggcgcaggtttaatcggaccccggccccgagctactggtccagcgtcgcggtcggcggggattatgcgtgcggcctgatgggcacggggaaagtcgcgtgcgtcggggacaatgtccccgtcgtgaataacaagcgaaacgggaccttcatagccgtcgcggccgggtctgggcacgcctgcgccatctcggtggataacaagctggagtgctggggggcagccgagaacgatccgccggaaggggtattcgtctcggtggccctgggagagaacaggagctgcgcattgaaggacaacggcagggtcgtgtgctgggggcagggcaatttcagcttgccggaacacctgggagacacatcgttcgtagccatcgaagccaagcgccgcgttttttgcggagtcttgacctccaactattctttgtgttgctggggcaatgagcacttcgactccaggcccggttccatggtgtttgacaacgtgctgcccggcccgtgccggaggagccaatgtccttgccttttgccgggctctgggaacttgtgcgggcaaggatatgcggtgtgtcgcccgtgcgtaaatccagctccagcgaaacatcctccactgccagggccagcaccgccaccgccaccaaccgttcagccccaggggttttgcatgggaaaactggtggtattcctggtggtggaatgcgtgggatcggcttcctttgctgtcggtcttcggtttcttgctgttcagatactgccaggggagggtctgccgcgtccacgattcaggccgccttgaagagaccccgcacccggatcaaactacgaaccccccgccacagcctgggccactggagaagcggctgagccatttggtcagcatggactcccacctggaggaattccccttgcaagtgctcgcccgcgttaccaatggattcgccgaagagttcaagatcgggacgggaagcttcggctcggtataccatgccacactggacgacggacgagaagtggccatcaagcgagccgaaatatcgacagcagcatcatcgccacatttcggcggtggcggcccaagcgtcaagaggcagaacgaagacatagacagggcatttctcaacgagctcgagtctctgtcccgcctcaaccacaagaatctcgttaagctatccggattctgcgaagatggcgacgagttgatcttggtctatgagtacgtgcacaacggtactctccacgaccatctccacaagtttcccgactccccgctcaattcgtgggtggcgcgtctccgagtagccttggacgcggctagggccatcgagtatcttcatgtctatgcaattccccccgtcatccaccgcgacatcaagtcttccaacattttgctcgacaaaagctggacggctaaggtttctgatttcgggctctctcttatgggccccgaagacgatgagtcccacctctcgctccacgctgcagggacgcttggctacgtggatcctgagtactaccggctccaaattctcacgtccaagagcgacgtgtacagctttggagtcgtcctgctcgagctactatcggggtacagggctattcaaaacaacgagaacggcgtgccaaggaatgtggtggactttgtgatcccctacatattgcaagacgagattcacaggatcctagaccggaaggtcttgccccctaaccctatcgaaatagaagccgtgaggtacgtaggatacttagctgcagactgcgtgagcctggaaggcaaagatcgcccgacgatcacggaaattgtatatagcttagaaagagctctggctacatgcttggcccgtcccaagctctctaggtcttcaacagaatcctcgaccgcgtagccatcctcattcgttgtgaacagcacggcgactcaccattcccaagccaaatgtgcagagaacaccattctttcttaattctttccatgtctacctgtctctttttgtacggttacattctttccttccttcgattcagaggagggaataagggcaatagatgtttctccaacatgccaaaaaaaaaaaaaaa

SEQ ID NO: 884 - DNA, 3280 bp, Eucalyptus grandis
gttttgcttcatgttttgagctgatagatatctagctccaacaccggagagtctctctaaccggaaaacgactctgaaccacctccaattatgccaagactaacctcatcacctcctcatattcacttcatcttctacatcccgtgtctcgtcttcctctgctccctctcccatgttgcagagtctcaagtccaagatcaagaacagcaagtcctcttgaagctgaggcaatcctggcaggacccatcttccctcgaccactgggtcacctccaattcatcctcccactgcacatggcccgaggtcacctgccaagacggctcgatcaccgagcttaagcttgccaacctgaacataaattattcgatcccaccattcatctgcgacctcaagaacctgaacaagctcgatctctcctacaacaatattcctggagagtttccaacagttctctattactgttccgagctcacgtaccttgacctgtcccagaattacttcgaaggtcctattccatccgatattgaccgcatggccaatcttcaggtcctgattctcgctgccaacagcttctcgttcaacatcccagtgtcaatcgctaggctgccgaagctgaggatccttcacctttatcagtccgagtacaatggcacgtaccctgaagagatttttggcctctccaatctcgaagaactgagtcttgggtacaatgacaagttcgcaccgtcacagttgccacagaacttcaccgccctgaagaagctgcggttcttttcgatgccgcagacaaacctgtttggcagaatcccggagaaggtcagtgatatggaggctctcgagcacttggatttggggattaatccactgacaggagaaatcccgggcagcatttttgctctgaggaacttgagccggttgtacgtgtacatgactaatgtgtctgggtcgatccctctggcagtcagcgctgcaaacctgagcttgatcgatctgtctgctaataatttaacggggaacatacctgaagttttcggaaagctcaagaatctatacagcttgaatttacagtccaatcatttgtctggtagaatcccggaagatatcgctcgtcttcccgctttgtctgatgtcaggctgtccaacaacaatctatcgggcaagatccccctggactttggcaagtttttccccgctcacgagattcgaagtggcctacaacaacttgaccggtacatttccagaacagctgtgccacggtggcacgctgttcgggttggccgctatggacaataatctcaatggggagttgccagagtcacttggaaattgcagttctttgtccgtagcaaggttgaacagcaatggattcaccggcaatgtgcctggaggactctggatgtcgcggaacttgacggctttgatcttgagtggtaatggattaactggggagcttcccaaagagctgtccccaaacctcactcggatcgaggtgagcaacaacaaattcttcggcaagattccaagcacggtgtcttcgtggaggaacttgaggatatttgatgctagtaataatctcctcagtggcacggttccgactgaattgaccgagcttccttctctgacgacgcttttgctcggtcagaacgagctctctgggattcttcccacagacatcatttcatggaaatccttgaccactctggatctcagtcacaataagatctcgggaccgattcccagcaaaatcggtcttctgcctgtgctcacgcagttggacctgtctgacaaccaactgtccggcttgattcctcctgaaatcggtcaactgaatgtgaaccgtctgaatttatcattcaatcgcctcagtggaccaatcccggccaagttagagaacgccgcatatgacgccagtttcctgaacaaccccaggctctgtgcatccaattcgttcatgaggatcaatgtctgcaacgcccaatcccatagatcgagcaagaccaatctcaccttgatcgtgatcttggccattgcggcagcgatgtgtgttttgttggtggtgctattcatgatcagagcttccagaaagaacagggattggtttgattcaactccgaaattgacttcattccaaagtttgaattttacagaatcgaatattctgtcgggattgaaggagcataatgtgattggaagtggtggatcaggaaaagtatatcgcattattgtgaatccttctggtgacgctgtcgctgtgaaaaggatttcaaataaccaaaagttaaatgagaaactggagaagcaattcgtagcagaagtggagatacttgggaacattaagcatcggcacattgtcaaattgttgtgctgtatttcttgcgagaactcgaaactcctagtgtacgagtacatggaaaatagcagcttggaccgttggcttcacaagaagaaacgatcgtcgcccatctcgggtgttgccaacaatatgatcttggattggcccaaaaggttgcagattgcgctcggagcagctaaaggactttgctatatgcataatgattgttcatcacccatcatccacagagacgtgaaatcgagcaacattctcttagactcagagttcaacgcaaaaattgctgacttcggccttgcaaggatgttggccgagcctggagaagctgttagcatgacagctgttgctggttctttcggctatttggcaccagagtatgctcatacaacaagagtcaacgagaagatcgatgtctatagctttggggtggttctcttggaactaaccactgggagagaggctaacgacggggacgaagacatgtgccttgctgattgggcatggcgtcacatccaagatgataacccgatatctgacgcattagatgaggagatcaaggacgactcaaacgtagatgaaataagcaatgttttcaagcttgggatcttttgcactgctactctgccttccacgaggcctacaatcaaggaggtactgcaagtgctgctcaaatgtagtgatccgctgtacaatgtcgagaagaaatccagacacaagtttgatgtcgtcccactgcttgaaaattccaagcacgaggaaacgctacgcagagattttcatgttcttgagtgcaacacttactgactattagcactagaacagttgcaagggcttagtgtagggctttggactcccaacttttgggaaacttttccaacttgtcttacatagagacaagcatcaaacgatttgtctaaaaaaaaaaaaaaa

SEQ ID NO: 885 - DNA, 986 bp, Eucalyptus grandis
aaggggagagagagagtctgagagagttttttggaaatgaagatagtgcggcatcttctactggtggccgtagcctggtggttgcaacaaggcggcgcttccaccgtggccggacattgtacacgcaggtgtgggagtgttgccataccttatcccttcgggctcgaaccccagtgcgcgagtaccgagcacaccaaagagtttttgctctattgcaataagaccgaagggataggtggtcgactactgttggggaattatacgatacgcaagatctcagtcagcgactcgaccatggtcatcagcctccccgaactatacgactgctacaacgagactggccggcaaataaacagaagctatctgtccatcgatctatcttcatatccaccgtacagattgtcggccacccggaatgccctcacagtcctcggttgtgacacctacgcgctcacgaacgtgaccgcggtggtcgacaaatatgatttttcccggggcggctgcatctcctactgcaacgagtccgttgacttggcgaaggagaccacttgctctggtatcggttgctgtcaagcatcgattccgaaggggctccggaagctccacattagaatcggctccttcaactatcacgagaatgtcttgccattcagcccctgtggagtggccttcgtgggggacaaagagtcattcaatatctccagcaagagactcccgaccttcaatgattcgggcaagagttcggaccttgttctggactggatgatcggatgggacgtcaattgcacacaggccaagtcgaacccgtcgagctatgcctgtggcaacaacactgactgtcacgacttcgcggatggactgggttaccgttgcttttgccagcatgggtataaggggaatccctatctctcccgcgggtgtcaagagtgcaagaagtctggcggtgatcttccccctcaaagctattgcagtgattctttcacccg

SEQ ID NO: 886 - DNA, 3108 bp, Eucalyptus grandis
ggaacaacgcgggctgctgtcgattgtatttgttatagtggttgcgctttgtccgctccggctttacgctttgttttctagctttttgttattcacttcgatggatcagctgaagactgaggagctcattttccttattctttaattagaatcccgttccatctctcttcacgttgatgtcagctcaggtgatctttctatcctttcttgattccccttatcagttcttcatcgatttattcgatagcttgcccctggaaacggttgtgtataagtctatgaattcgctttttagttcttgcccttcgaattctttttaagctgtcgccattgactggttttatttgaacttatccgacagcttttgatgatcaaggtccgtgaattcatgtcctgggaattgttctgcaaccatcttgaatagcccattttcattatccacctctccgagctgttccaaagatggggaatctgagttttcagttgatcctctcatgttcatacctcttctgtttgatttgtatagcttcaggatttgttccattggataattatctgatagactgtggatccccacggaatgcatccgttggtaatcgcacgtttttggcagataacttctactctgatatactttcgactgcacaaaacattcttgccaacacaaactcgagttctctttcatcctcctatgattcgactctgtatctcaccgccaggatcttcgaccaagcctcccgttacacttttccgataaaggaaatggcaggcacttgattcgcctctatttcttcccttttgtctatagagagtacaatctgagcacggccaaattctccatctccgcacagaattttacccttctcgagggtttccagttagacaagggctcagtcgtaaaggaatactcattcaacatcaccactaatcagctcgttcttactttcacgcccaataccgattcattcgcctttgtaaatgctttggaagtcatttctctcccgattgagctgatccctcacagtgccagaatcgttgaaatgcccggagactatcagaatttgcagagtaaagcactagagactgttttgagagtgaacatgggaaatcaaactgtgcatccgcagaaggatacgttgtggcgtctttgggtctcggatgacacgtttttgaagcacagtacggtgtcaattgtgtcgaacgttaaagctgtcacctataagaatgggaatgttactgagaacattgctcccccttcggtctatgggacggccaccaagttggattcggtccttgatcctaaccttaacgtcaatataacttggctcttcagtgtcgatgctgggttcaattatcttgtccgattccacttctgcgacattgtgaattctactttggggtcgttcttattcaacgtctacatcaattcctggtttgcctacagaagtttcgatctcagcacactgacatccaatgtcatcggccgcccgtattattttgatgtaattacaagttccaccagcagtagtgcactgagtgttagtgttggcccttctcctgagggtagttaccccatggccatcctcaatgggctagagatcatgaagataagtaactctcaggacagtcttgaaacttcagattccgagaatggttctttaaagactaactcaaggagcaagatcattctgatcgcaggcttgtccggcgggatttgcatcgttcttgtcgtcgtttcagcgctcttctttgtctgcagaagaagaagaaagctagcagctgtgggtcactcaaaggaggacaattttgtcatgactcagacaggagataagaactcgaacagcttggcagtattttccacctcgacgttcggctatcgctacccattcacggcgattgaagaggctacgaataattttagcgaagatttgataatagggacgggaggtttcggcaaggtctacaagggaattttcagagatgggactaaggtggcagtgaagaggggccaatccaagtcgcaacagggcctgacggagttccgtacagaaatcgagatgttgtctcagtttcgtcaccgccatctggtgtcgctgatcgggtattgcgacgaacggaatgagatgatcatcatctatgaattcatggaaaacgggacccttaagagtcatctgtactgttcggatcgtcccgtgctgagttggaagcaaaggctggagatttgcattgggtcagctaaagggcttcactaccttcacaccggctccacaagggcaatcatccatcgcgacgtcaagtcggcaaatatcctgttggatgagaatttgatggccaaggttgccgatttcgggctgtcaaagaccggtcctgagatcgaccagacgcacgtgagcacagccgtgaaagggagcttcggatatctggatcctgaatacctgacgaggcaacagctcacggaaaaatcagatgtctactcattcggggtcgtgatgcttgaaatcctttgtggtagagcggttatcgatccgtcgcttcccagagaaaaggtgaatttagttgagtgggcaatgaaatggcgagaaagagggcgaatccaagaaaccatagaccctcatcttgtggctcaagcaagtgaagagtccctctggaagttcgtggagattgccgaaaaatgcttagcccaatgcggtctggatcggcctcagatgggagacgtgctgtggaacctggaatctgcacttcaagtccaattgaaggaagaaaaaccgagcgataaaggcgagctagcccctcgagcggattggattggttatctggacactcatcctagcgcttcgaccactcaattcagcatgggaagcctaggcgatctcgcgagtgtctcgatgagcaaactgttcgccaaaatggcgaaagaggatatgaggtagaccccccagttcaaagttttcgccaggtttggttcaaaaggagcctctgatgtgtaaacagcattccagatttgaatgctggtgtcaacatgacattttacttcatgaatgtataatccatttgtaagcctgttgggctctataatctatattgcttttctccaaaaaaaaaaaaaaa

SEQ ID NO: 887 - DNA, 3715 bp, Eucalyptus grandis
ggcagaaatcctaagctaggcagagtctccgacgataccaaacgatttatagttcctgcttctcttgtttcgtgatgggtttcttctaccaagtctttctcatatttctggcggtcgcgccgtctgctctgtgccaagttactgagttcgtcagcatagactgcggaggatccagcaactacacagacccgacaacagggctcgcatggatcccggacacgggtctcatgagctatggccagtcttcgaaggtgcagaatcccaacgtaagctcggtgcagtattcgacgcgcagggacttcccaatagacggccagaagtactgttacaccctccggaccgaagagagaaggagatacatcgtccgtacgacgttcttgtacggcaacccggacacggagcgacgttccccaagttcgacctctacttggacacgaccgagtggacgaccgtgaccatcttcgacgcagcccgagtttacgtgaaggagatgatcatacgggcaccttccgaatcggtcgatgtgtgcctgtgctgtgcgacgactggggctccgttcatttccactctggagctcaggccgttgaatctctcgatgtacgccactaatttcgaggataaattcttcttggaggtggcggcgagggtcaacttcggggctctgactccggaggctttgagttttctctaggtacccggatgatccttatgatagaatttgggactcagaccttgaaaagaggcaaaattttctggttggtgtagcctctggtacagagagaatcaacacgtcgcaaaatgtagatgttagtaccagagaatacccacccgtcaaagtgatgcaaacggccgttgttggcacgaaagggttgcttacctacaggctaaacctggaagattttccaagtaatgcccgtgcttatgcatactttgccgaaatcgaagacttagggccgaacgagacccggaagttcacattgacggagcctgacttcggtgactacaacaatgctgtggtgaacattgttgagaatgccaatggtagctaccgactttatgaaccgagctacatgaacgtgtctttggctttcattctgtcattcgcctttcaaaagacctcagattctacccaaggaccacttctgaatgccattgaaattagcagatatgcacagattgcttcaaggacggatgtgctagatctgacagtggttgatgcccttcactccatgtccagtgaaaacgttttcacagatcaaggtgatccatgccttccagttgcttgggagtgggtgacttgtaattcgatgacgccaccaaggatcacaaatatgtgagctcctcatgttaatcatctatgcaactctttattgggttctcctgtgtattctgactttagtgtgtcttgtgatgtggggtattatatgagcttgtcccttaagtaatacctaccgattgtgctagtcagactatagcaattttcaatgtatttaggatcttcaagagagaggaagagggaaaatagtcaaaggttatatctttagtcaataacttgataaagtggtgcattggcagttttattcatagaatatgagaggcactaacgatatcgataatattcaaagttctggacaattcatggctgagaaggctgatccaactggtgttatattgaactattagagcttataatctaaagattgttctactttatacagtacctcattagagatgcccaaatggctgggcccaggcctgagatcaggcttaactttgctctcaaattagtccagctatttccataaaattgcctatcccttttcgggcatgaacaggcacgcagaaggctcactcatttgctcctcggacctaatccacaaacaaatctagtactctcaattttaagatttttaatgtttcatagctaatacaatggactgacctgttgagcagacgcctatcaggaagaggcataaagggcatgatcccctctgagcttaataatttggtgcagttgacggaattatggctggatggaaattcattttctggcaaactccccgatatgagcggcctcaccagcttacagattgtgcatttagagaacaaccaattgacgggtcccttgcctccttaccttggtactttgccaaatttaatcgaactgaatatcgaaaacaactctttcactggtgaaattcctccccaactgttaagtgcaaaaattaaattcaaatatgggaataacattggattgcatggacactcaaggaaaaagatgcagttcaggtggatacttggagcttcaattggagtatttgcagttttgatattgttgcttctaggcagtctgctactcttgcataatcttcggagaaggaagtcccaccagaaaagcaatgacaaaggtggttcattgcgtactagcacaaagacttcaactgcatattcaattgttcgagatggccatttaagggaagaaggctcgcactatatagctctttctgatttggaatcagctaccgataggttttcaaagaaaataggtaaaggtagcttcgggtcagtgtactatggaagaatgaaagatggaaaagaggtggctgtaaagatcatggctgagatatctaatgatgggcaccagcaatttgtgactgaggttgcactcttgtcaagaatccatcataggaatttagttcctttagttgggtactgcgaagaagagcaccaacgcatcttagtatacgagtacatgcacaatggaaccttgcgtgatcacatacatgattctgtcaagcaaaaggagctagactggcttactcgtctcagtatagcagaagatgcagcgaaaggtcttgattacttgcatacggggtgtaacccaggcatcattcatcgagatgtgaagacgagtaacattctgctagacatgcacatgagagcaaaagtatcggatttcgggctttcaaggcaagctgaagaggatttgacccatgtgtccagtgtagcccggggaactgtagggtatcttgatccggagtattatggaaatcaacaattaacagagaagagcgatgtgtacagttttggagttgtccttttggaactgatttctggaagaaagcctgtgtcgccagaagaagattatggttctgactggaacattgtccattgggcaagatcattgattcgcaaaggggatgtgatgagcatagtcgatccgatactcatagggagcttcaagatcgagtcagtgtggagagtcgcggaagtagctctccaatgcgtcgagcagcatggagtctcccgccctaggatgcaggagatcatattggccatacaagatgctaccaagatcgagaaagacgcagagagccgcctgaaaaactctcctagcagttcgagggctcaatcctctcgcaagacattgctgacaagctttctcgaaatcgaaagccccgagttgtcgaatggctgcatagtcccatctgccagatgatgacgagcgagcaaatactttctggaaattggccgggcgactcttgtagcttgcataccgatgatccaatatggagagtgtagagagcttttgaaatttgtcttacaactctgtataacgattctaacaaaattttgtaaagggaaacagtcaggtttgaatactacattggagaggtaagagaacagtcacagcagtaaaaaaaaaaaaaaaaaa

SEQ ID NO: 888 - DNA, 4356 bp, Pinus radiata
agacgatggagggaggagaacttggtgtggcgttgaatgtggttcggcaattgatcgaagattaggcaatgctggctgatactcagaatactcggaatactctgaactctgttgtttctcattgccactgtgtgtatctgcagccatggcatttgcctctgacatttggcgctggagaaaactcagtgtgtgtctgtcttccttagttacatttctttacttcttcggccttctatctgctgtttctgatgatggagcaactctcttggcaattaagaagtcgtttcgtgatagtgataacgttctatacaactggattgattctgcttccagtgatcactgctcctggaggggtgtcacctgtgacaatgtcacctttgctgtggttgcattgaatctctctcatctgaacctcggaggagaaatttccccagtgattggaaatctgaaaagcttagagtcaattgaccttaaaggaaatggtctctcaggccaaattcccgacgagattggagattgctctgcattgaaaatcttagatgtctctttaaattatttatacggagacattcccttttcaatatcgaagttgaaacaactagaacaactgattgtgaagaataaccagttaatggggcctataccttcaacgttgtctcagattccaaacttgaagaaaatggattttgcagacaatcaattaagtggggagattcccaggcttatctattggaatgaagttttgcaatatttggggctgcgcaacaacttcttagttgggactctttcccctgatatgtgtcaattgacaggattgtggttctttgatgtgcgaggcaacaacttgtcagggaccattcctgagaatattggcaactgtacaagctatgcagttttggacttgtcatacaatcaacttaccggagagatccccttcaatattgggtttctacaagtggctactctgtcgttacaaggaaacaagctgaccggaaagatacctgaagtaattggtctcatgcaggctcttactgttctggatttgagtgataatcatcttactggaacaattccttcgattctaggcaacttgacttacactgataaactatatttacacagtaataatctcacgggatctattccgccagaattggggaacatgacaaagctgggatacctgcagctaaatgacaatcagctgactgggcaaattccacctgagctggggaatttggaacagctgttcgaattgtaagtttgtgtccaaacctttttctagaaagtggagataaaaatgatagaaatatcttgaaacctcccatacactaaacattaatctatgatatcttttggattcttgctgtaagtatttaacattccaaggttgtattttttttgagacagaaatctagccagaaatcaacttgaaggtccgatcccagagaatattagttcatgtgttgctcttattttcttgtaagtgatataatcttcaagccaagtgatgaatttgcggagcataatttcccactggctaacaatattaacgctgtgccttcatggtcctttgtcctgtagcaatgtgcatggcaaccgtttgaatggaactattcctttggaatttcaaaaacttaacaggctaacttatctgtaagtagtcctgggccatattctaaattgacctataacataacgagctgttgagttgcattaagcatattcaatgtgactaacggataacgttgttgcttttacagaaatctgtcctccaacaatatcacgggaacaattcctgtagagctggggcatattataaatttagacagattgtgagttttagttattctagtgtcttggttaaagcttctaaggttcccttttagaactatatctaaaaacataatagctgcaagggtagtccttacatttttattgccctgtgatgtgatgtgaatttttagggacatttctaacaataatatatctggacctatcccgagctctattgggaacatggaacatctattaaaattgtaagtcttgtatgtagaaaagtttttgaattattaagctacaaattttatgtgtgaaagttatatttatttttaaccccattggattatgaaaagcttaatgggtgagagttatattaatcccatgatttctattggattatgaattcaaggaacttgagtggaaataaactgagtgggtttctccctgcagacttgggaaacttgagaagtatcggggatatgtaagtccttagtatttgatttgggtagcttgtgaactagtgctattttctagttctttctacatctctttctggtgtgccctagccacttcatcaaaacagtaacatagtgtggtatttttttaatgcagggacctttctgccaaccaattatcaggtcctattccttcagaacttggacaactacagaatttggtctcactgatactgaataacaacagtttatcaggggagatgccatggcagttgaccaactgctttagccttactactctaaacctctcctacaacaatttgtctgggaatattcctgtcacacagaactttacaaggtttaccccagaaagtttttttggaaatccaggtctctgtggttattggattggatcactttgtgggatatctgccagacaaccaaaagcttctgtgtcaacaacagctattgtttgcatctcattgggttcagtgatattagtgtgtgtaatcaccatcgctctctacctttcaaatcaacataaaccattcactaaagggtcatcaagcaaaacgggtcaaggttctccaaggcttgtaatattgcacatggatatggccctatacatgtatgatgatataatgagaatgaccgaaaatttgaatgagaaatttataattggcaatggtgctacaagcacagtttacagatgtgatcttaagaactgtaagccagttgctattaaaagactatacacacactatccacaaagcttgcgggaattcgaaactgagttagagactgttggaagtatcaaacatcggaatcttgtcagtttgcgtgggtactctctttcgccacatggcaacttgctgttctatgactacatggtaaacggaagtttgtgggacatcttacacggatcttccaagaagattaagctagactggaacactcgtctaaggattgctttgggggctgcacaaggtttagcatatctgcatcatgactgtaatccacgtattattcacagagatgtaaagacttccaatattctcttagatgacaattttgaagcgcatctgtcagattttggtattgccaagtgtatcccttctgcaaaaacccatgcttctacctatgttatgggcaccatcggttacattgaccctgaatatgcaaggacgttgaggctcaacgagaaatccgatgtgtacagctatggcattgttcttttggagctactgactgggaggaaacctgtggataatgattctaatttacatcagttgattctctctaaagcagacaacaacatggtcatggaaactgttgacccggaagtagtagcaacctgcatagatcttgagactgtaagaaagatcttccagcttgcactgctttgcacaaagagacagccatcagaccgtcccaccatgcctgatgttgctagggttttacagtcattattgccaacttctaaacaagctccaagtagcagagtaaaccaaccagcagccagtaacaactacaggagatacttggatgagtacactgaaggaaatcatagagatgttagaggcagcagcacgagcagcagcacttctgatgggcaattatttgtgagatttggtgaggttatttcacagaacattgtttgacagaaacccttggattgagctcatgatcaaaagtgtgtaccatattgttgacttctaccttcagtgcagtcatttcatcaaaaactcaaattttgtagttttgggttttcaacaaagtcagctgccgaaagtctggacttgttaatacaagattacattgccaaataaacaacccatatatggcatgcagttgaaattgtacccaaacattaacttaatgcggatacgcctgcgttaaggtgtcaaactttaaattgctgctagacagatagtgagagaagcttttgttgtgccacaccccaagatagaaatgcctgttgtttggattgaagtcctccccttctgtcatagcacggcagcaatatatacagttgcgatatgttaattgtggatgcttgtacacgaatgttatatgtttttacaatgaatgcggaattttaactgaaaaaaaaaaaaaaaaa

SEQ ID NO: 889 - protein, 996 aa, Pinus radiata
MAYKLLRFWLEFQALLVLFPLALSVSQEGLVLLEVKKELSDPNGFLGNWKAEDDSPCKWRGISCDQRSKSVVGIDLSSGGLVGVFPSVVCNLPQLKNLSLGDNNIGSILPRNLSMCRQLQRLNLSQNLFVGNLPDFISELAELEYLDLSSNNFSGSIPAGIGKLPRLQVLNLCCNLLNETIPTFLGNLSNLQQLLLAYNPFAPGVIPPELGKLAKLQNLWATSCNFVGAIPDSIGNLLSLTNLDLSSNQLSGIIPEAITKLNQIVQIELYHNNLTGRIPENWANLVSLRHFDVSTNMLNGTIPEQLARLPLSSLNLFENNLVGTIPEAIGYSPTLSELKLFTNNLNGSLPSNLGKFSGLQTLDIAGNRLSGTLPPDLCKYGKLQTLNIFNNNFTGQLPLQYGACLSLQRVRISHNELMGQVPSSFWGLPHVYYLELSNNKFEGSISSEIRNAKNLSALLISGNRFSGTLPSEIGLVANLSVIDGSHNQFTGPLPATLGSLNKLSKLHLFQNQFSGSLLTDILSWNELTDLNLSNNRFSGPIPKELGELPVLTYLDLSVNALTGEIPPELGNLKLNSFNLSDNQLTGIVPSAFSLSFYKSSLMGNPGLCSNDGLKGFKSCSDMENSGRKKCYSWAWLLPALFALAGVIFVLGLALFYRQYREYNKAKVKDLWRSNKSPWMLTTFHRLGFREYEILDCIDEENVIGSGGSGKVYKATLGNGETVAIKRLWNNGNAEGSTSCNDNGFKAEVETLGNIRHKNIVKLWCCCVNDDSNLLVYEYMPNGSLGDLLHGPKAGDLNWPTRYKIAVGAAQGLAYLHHDCVPPIIHRDVKSNNILLDADFGARVADFGLAKVLQSYEKGIDFMSAIAGSYGYIAPEYAYTLKVNEKSDIYSFGVVLLELVTGKQPVIQDFEESKDVVMWVRTRIEKQNDGLQDILDSRVMVDCFREEMAAVLKVALLCTSALPINRPSMRRVLELLHEAGQLHNVKDVVTKDLNLFP

SEQ ID NO: 890 - protein, 804 aa, Pinus radiata
MDLLLLLLVMMGVAMPTHSQHTGGFTSVQRFPFNGRSMMGKPSIAGYHEKRDVEALLSFRKGITLDPYGWLSNWTANNSHNVCLWNGISCSPNTNRVVEISLRYGRLNGTLSPYIGNLSLLRHLDLSSNALSGRIPAEFGQLKALRILDLSNNALTGSIPTCIGNGGLNGTLDLDLSWNAFSGRIPKELFNCTRLQRIDLSHNSLTGSIPTSIGNCALLQTLNTGFNYLSGSIPTSLANCTSLTDLVISSNNLSGPIPSEFSGLVSLKFLFLDDNSISGSIPTSLVNCTSLFALKGSGNKLSGPIPSVMGLMKSISTIDLSNNSLTGRIPTTLVNCTQLYELYLSTNNLRSSISIPPSITDTDLVYLDLSNNQLIGSLPRNIGQLSSLQSLVLSNNNLTGSLPHNIGQLSDLQRLDLSNNNLTGSLPLSISHIEDLQELDLYNNNIFGTIPNTISLTSLQILDLSKNNLDGSIPELNGSCPELSFFSVHTNKLSGTLPMFLANCIEIQYLDLRKNNLTGHLPHYLKSFSELLILNFGYNNFHGGIPEWVTNFTYLYVLDLSNNKFSGRMPLHFERLQGFVNSSNNDDSEEKEITVHMKGCEYTLPYISSENTILDLSNNNLVGQIPPSIGTLRDMRLLNLSGQLEGLIPASLSNISTLEQLDLSKNNLSGHIPQELSKLYSLAVLDVSSNSLCGPIPGGTQFSTFSATSFQRNKCLYGCPLDSCSEKENPVGEGDNNSSSAHMKMGWLEHLDEKMSLMALGIGFGIGIWGVVGVFIFCNRARHWVLGLPPNKPQLFYGMYRFPT

SEQ ID NO: 891 - protein, 677 aa, Pinus radiata
MEVRMITIMILCAALLCEGSGEVDVLMEMKAALDPKGEILYSWVKGGDPCSGTFDGVACNEQGKVANVSLQGKGLSGSIPSTIGKLKCLTGLYLHYNSLGGEIPRELSNLTELLDLYLNVNGLSGPIPKELGAMSSLQALQLCCNKLTGPIPMELGSLKKLNVLALQNNHLNGAIPASLGVLTSLTRLDLSFNSLFGPIPTTLTDLPHLAILDVRNNSLSGKTPQGFKRMQEGFRYGNNSKLCGEEFAGLAMCNGSSPLIRPEPFGSRAPNLTVKSPGDSSVPPLQKIPESADFSRSCQNCSKTFKTPSIAIVVAVIALIGGGILATVFTFSWFRRRKQKISSAYETADSRLSIDNSKDFGRKSITPLISLEYSNGWNPLADDGTGCERFQSSRFNLEEIESATQYFSEKNLLGKNNYCAAYKGVLRDGSFVVIKSISKMSCKTEELEFQEGLKTLSLLRHENVVRLRGFCCSRGRGECFLVYDFAPNGNLLQFLDAKDGRVLDWPARVRIAHGVAKGIEYLHEGISKAVVHQNISAEKILLDQHLNPLLSDCGLHKLLADDIVYSILKSSAGMGYLAPEYTTVGRLTEKSDVYAFGIILLQLLTGETRINSSSIRSLVQSGRPDEFIDITLGKEYSKEEASNLARIALDCTNEVAAQRPPISVVLQKLAWIDDKEQ

SEQ ID NO: 892 - protein, 343 aa, Pinus radiata
MDLLLLLLVMMGVAMPTHSQQTGGFTSVQRFPFNGRSMMGKPSLFPSSIAGYHEKRDVEALLSFRKGIISDPVGSLSDWTANNSHNVCLWNGISCRPNTKRVVSISLPECLLNGTLSPYIGNLSLLRHLDLSFNALSGRIPAEFGQLKALRILDLSGNALHGYIPKELFNCTRLQRIVGQIPASIGTLREMRLLNLSGNQLEGPIPASLGNISTLEQLDLSKNNLNGSIPEELSKLYSLAVVDVSSNSLCGPIPRGTQFSTFSATSFQRNKFLYGCPLDSCSEKENPVGEGDKNSSSAHMKMGWLEHLDEKMSLMALGIGFGIVIWGVVGVFIFCNRARQRTK

SEQ ID NO: 893 - protein, 843 aa, Pinus radiata
  VARIANT (1)...(843): Xaa = Any Amino Acid
MDLLLLLVMMFVCSVMMGVAMPTDGFTSVESVPFNGRNRHKRDVEALLSFKESIISDPYGSLTNWTANNSHNVCLWNGISCRPNTKRVVSISLPECWLNGTLSPYIGNLSLLRHLDLSWNALSGRIPAEFGQLKALRILDLSASHGLLHGYIPKELFNCTRLQRIDLSHNSFTGSIPTSIGNSALLQTMNLAENQLRGSIPAEFGRLVHLESLQLYSNTLSGSIPTSLANCTSLIKLELSDNNLSGPIPSEFSRLVRLETLLFDDNSISGSIPASISNCTSLQYLDISDNSLSGPIPSEFSRLVSLESLYFHDNSISGSIPTFLVNCTSLSALGASGNKLSGSIPSVMGLMKNISFIDLSNNSLTGHIPPTLFNCTHLSSLSLATNNLRGSIPPIIITNTELMDLDLSNNQLIGSLPRNIGQLSNLQSLDLSNNNFTGSLPRNIGQLSNLYLLDLSSNKFTGSLPLSISHLDLQALYLYNNNISGTIPNNISFSDIQILDLSNNNLEGSIPKLIGSYXVLKIFSIHTNKISGTLPMFLANCTQIEYLDLRKNNLTGQLPHFLEYFSLLKILNFGYNNFHGGIPEWVTNFTYLYVLDLSNNKFSGRMPLHFERLQGFVNSSNNIPFGVSGEITVHIKRCEYTLPYLSEINTILDLSNNNLVGQIPASIGTLRDMRLLNFSGNQLEGPIPASFGNISTLEQLDLSKNNLNGSIPEELSKLYSLAVMDVSSNSLCGPIPRGTQFSTFSATSFQRNKCLYGCPLDSCSEKENLVEEGDNNSSSAHMKMGWLEHLDEKMSLMALGIGFGIGIWGVVGVFIFCNRARHWVLGLPPNKPQLFYGMYRFPT

SEQ ID NO: 894 - protein, 705 aa, Pinus radiata
MLLCFVLVAGTSAAVDDHQYLYHPSHYVMNERQESGSSMARHEKRDVEALLSFRNAITADPHGLLSNWTAHNSANICSWNGIGCRKQSRRVVSIYLRFSHLEGTLSPSVGNISLLHTFVLTVNKLTGRIPPEFGQLKALQTLDLYRNLLSGSVPGELGLLQKLENLHLHGNNLESIIPPSLGNCSSLTSLWMAGFYSRRVLFPQGSIPAGSIPAELGNCSHLSSLSLVRFRLTGFVPDFIYRLPLSELDLRFNNLTGKLPKAIANLSHLTSLQLGSNNFIGSIPKAITNLKRLQFLDLSYNYLTGIIPKGVGKLHSLEHLYLESNNLTGSIPYSINGLFSLQVLDLSQNNLEGPIPKSIGNCTSMRVFSAHSNKISGTLLTSLANSTQLRLLDLRRNRLMGELPSYLAYFHDLKILTLAHNNLHGPIPQWITNLKKLHVLDLSNNRFSGKLPSQLDRLSGFTINESAPMDGVTITQFGIEYFTNFSDETLFFEEMVFDIKGVEYKLPYVLPISTIFDLSSNSLNGQIPTSIGGMSSLRLLNLSRNQLEGLIPASLSNISALEQLDLSKNNLSGEIPQELSQLHELGVFDVSSNNLCGPIPIGTQFSTFNVTSFQRNKCLYGCPLDTCNENKRPKREENNTTMSGKHVVGWLSRVDEKMSLMALVIGLGIGFGGVIFVFVVWEKARHWLLSPKRPQTFYGVYRFPE

SEQ ID NO: 895 - protein, 998 aa, Pinus radiata
MRERETKVCIFIFCIFTSWALVDFGVPAVFAAQETQIQILLRMKEALEDPTNALRDWDGSEDSPCRWRGIDCNDEGAVTRIQLHGSSLSGRILPDICNLQSLIIFELDRNSLYGNFPPEFSNCSRLEQLNLSSNLLNGSLPDLSKLKALKYLDLSNNRFSGEFPVSVGNLTNLESLSLGINMFNRRTIPEELMRLTRLSWLYLTNCNFYGSIPASLSNLSELGNLELSMNDLTGRIPKELGSLKKLYQLELFSNLLSGEIPPELGNLTSLRDFDASRNSLCGRIPADFGKLERLHFIQLYQNQLSGEIPEGFGELKNLIGISMYQNYLTGPLPPKLGSVSEFNMIDVSQNMLSGPLPPDLCSGGKLQYILVLDNEFTGQIPESYGNCKSMLRFRVSKNKLTGRIPRGIWEFPHVSILDLSFNSFEGEIAPAIGNARNLSELYLQRNGFSGNLPAEIGQASQLIKIDVSGNKLTGAVPSEIGKLSLLNSLSLQENNLSGPIPAQIGHCKFLSSINLAYNELTGPIPGSLGFMEVLNSLNLSHNMLSGEIPNTLAALKLSSVDFSRNSLTGPVPIELISQTNNRSFSGNPGLCGQGLESLQPCDLHTRDVYQERWITGWIVSGTVFTFLILGMLIRGCRLHRRDSNKVNNRTFWEMKSFHKLNFDEHEVLESMDEEHIIGHGGSGTVYRIQLSNGESVAVKKLWTCKNGHHGGQGLINRELKAEVETLGTIRHRNIVKLYCYFSNGDSNMLVYEYMPNGNLWESLHVGNRGASLDWPTRYKIALGVANGLAYLHHDCQPGIIHRDVKSTNILLDAENQARVADFGFAKILQACPRGDSSVRITGTHGYIAPEYAYSSRVTEKSDIYSFGVVLLELITGRRPVEAEFGENKDIVYWISRKILTREGAFEVLDYRIYELYKDEMIQALKIAVRCTSKLPNVRPSMREVVQMLLEAKPRNIVKSVQGKNNNDEKPVYTKESSIVHIPAADCKPKSDSKPQSKA

SEQ ID NO: 896 - protein, 864 aa, Pinus radiata
MRMFLLLVYLFPLVTPFAFSTVQLSNGSNAVDQEAVLGFLSAITNDPYQSLPTNWKSNVSVCEWTIIKCNGSRVVSLNVSSMGLEGTISPLLGNLSFLEKLDLRNNNFHGPIPYQLGSLVRLQMLILSSNKLQGSIPPTLSGCRNLRFLYLSANNLRGSIPSELCVLSKLAYYILGQNNLSGRIPTCLGNMSSLYKIYLGSNNLHGRLPSELSMLKVVDHIDVWNNSLTGEIPSSLSNCTNLRNLSLGRNQLSGHIPADLCSKHTRLIGLYLHGNYLSGSIPASLFNCTKLHIIELGENQLSGAVPMELGKLTQLQVLHLGNNKLISGSTTSLPFLTALSNCSLLRVLDLYSNNLTGRLSSSIAQFSTKLEVLYLDRNKLHGEIPPQIGNLTGLTYLGLGMNCFSGAIPSLIRLQKLERLYLSVNDLQGNIPTEIGHLKRMGLLQLGLNNLSGRIPESLAGLQQLRKLRLAHNQLSGNIPASLGKLVTLEELDLSYNRLSGRIPPEVAGLVNLAFYFNLSNNLLEGPMPLELSKMTKVQAIDISANKLMGSIPSALGSCTALSYLKLSYNALEGLIPASISELQNLQDMDFSSNKLSDLDFKALIFPFMENGSLEKWLYPNIAEDSCDLSLIQRLNIAIDIAHGMAYLHHHCFVQVIHCDLKPNNVLLGDDLTAYIIDFGIATICFANSEESASTSTYALKGSVGYIPPEYGQGGQVTTKGDVYSYGIVLIEMLTRKKPTHSLFAEGMDLRKWVSSCFPNQLEKVVDKILLTSDSTNNTEEDKREMCLGQLIRVGLLCTQQSSEMRPNMMDVVEKLESIRDTFLKATQNSNSNQISYQRLLGSSNTSGNQAGTSAPSNSDSSSF

SEQ ID NO: 897 - protein, 692 aa, Pinus radiata
MDLLLLLLVMMGVAMPTHSQRFPFNGRSMMGKPSLFPSSIAGYHEKRDVEALLSFRKGIISDPHGSLSDWTANNSHNVCLWNGISCRPNTNRVVSISLPYCRLSGTLSPYIGNLSLLRYLYLSNNDLSGRIPAEFGNLSLLRQLDLSSNDLSGRIPAEFGNLSLLRQSDLSSNDLSGRIPADFGNLSLLRQLDLSSNDLSGRIPAEFGNLSLLRQLDLSYNAFSGRIPADIGNCALLQMFHIQRNYLRGSIPAEFGRLVHLESLWLSMNALSGRITSLGNCTSLTDLDINNNNLSGPIPSEFSLLVSLEILWFNDNGISGSIPASIGNCTSLSDLIGSGNKLSGPIPSVMGLMKCIHNIDLSNNSLTGHIPPTLFNSTHLSSLKLATNNLRGSINPPNISTNTELIILDLSNNQLIGSLPRNIGQLSNLQHLYLSNNNLTGSLPHNIGQLKNLSELNLYNNNISGTIPNTINLTSLEILDLSKNNLEGSIPELNGSSLLISFFSVHTNKLSGTLPMFLANCTGIVYLDLRKNNLTGQLPHYLKSFSFLSILNFGYNNFHGGIPEWVTNFTNLYVLDLSNNKFSGRMPLHFERLQGFVNSSNSVFSLDEEITVHMKGCEYTLPYLSPTNTILDMSNNNLVGQIPASIGTLREMRLLNLSGNQLEGPIPATLGNISTLEPLNFNQKKLKGANPE

SEQ ID NO: 898 - protein, 383 aa, Pinus radiata
MAPLLGILLLHALIFSYGEEAHVAGSNHTEVRALMALKAGIVDTSGHLSDWEVHGDELSASPCSWTGVFCDLESENVTELDLSRMNLTGTISDEIRELQHLKVLNISFNQFSGAFPVVIFNLTRLRSLDINHNSFEGYFPAGISKMKNLVNFIAFSNSFKGPLPLEFVEMAFLEQLNLGGSYFNGSIPEQYGMFKNLKYLHLAGNSLTGKIPPELGRLHGLRHLEIGYNFYEGGIPWQLSNMTELEYLDIAQANLSGALPWELGMLRKLNALFLFKNNLSGTLPPQLSNLRSVLSLDLSNNTISGSIPLGFSRLKNLKLLSLMYNNLSGSMPQGIGNLPNLEIVQLWNNSLSGILPPNLGRNRKLKQLDVSSNQFTGPIPPDL

SEQ ID NO: 899 - protein, 339 aa, Pinus radiata
MRSVFRISSLLVISILVLLTLSSAINDDAETPRAQNTHIADPHRPRPGDTDPHPQNLWGDTRPLQKKQNKKSARHDKNKNLAHHSAPDIIEPRQSRESQLGAQQIQHAVPVGVLDISTLRFLNISNNNFSGEIPANISRLVNLELLDTYNNNFSAPLPLEVASLARLRYLHLGGNYFYGSIPAGYGNLTSLHYLGLNGNGLTGNLPPELGKLAELRYLFIGHYNNYSCEIPPQFGNLKKLIRLDMSNCGLMGSIPAELGNLSSLDSLFLFLNVLSGPIPPQLGNLRNLKSLDLSFNDLTGQIPEEFKNLVSLTLLNLVHNRLHGGIPDSIGDLPDLEVL

SEQ ID NO: 900 - protein, 1166 aa, Pinus radiata
MAPSTDFILITSTLMLIFVSANAHLLHHYHEKSRERLQVDIEALQAFKASLTYDPSHALANWDFVANHVCNWTGVTCNPHKLRVSALNLYNMSLQGTIPPHLGNISFLGVLNLTLNSFSGIIPNELGKLRRLKRLSLKQNQLISSIPEALKDCTSLRLLNLSHNNLTGTIPSGLGQLQNLQNLSLSFNGLTGKVPETFGNCSALEILGLGSNFLSGTIPSHLGMLARIKILSLGRNQLSGGIPPSLLNCTELRGLYLYENRLTGEIPWEIGAKLSKIETLSLGGNQLSGGIPPSLLNCTELSELDLYENRLTGEIPWEIGAKLSKIETLSLGGNQLSGGIPPSLLNCTELSELDLYENRLTGEIPWEIGAKLSKIETLSLGGNQLSGGIPPSLLNCTELSELELDENSLTGGIPQEIGKLRILQDMDLDNNHLYSEESISFFGALSNCTNLQMLSLSSNDLKGDLPGSIDRLSQNLLYLYLGGNRFTGKIPQEMSNLTGLILLDLNDNLLSGGLPSALGRLSALQALDLSRNNLEGNIPCQFSQLKRLYALELYQNAFSGEIHQVFASLQQLRRLDLSYNKFSGNIPDNDIGNCSNLELLDLSYNQLSGLMSWKVASLHNLQFYINVSHNALTGRVPAELGGMHMVQAIDLSANNFSGSIPGQLVNCAELDYLNLSHNSLEGTIPTSIDQVAGLQDLDLSFNKLSGPLPTSIEKLQKLTHLNLSYNNFTGEVPSSGAFRKLNLTSFLGNSGLCGRWIELPHCKLTTRHHHDSKRRVVILATSVGLTLLLVFCLALIMVLIYFRSKKSALLETISARLGRMLRSQLRETKIVSEEEVNRATNGFSPDNLLGRGGHGSVYKGVLENGTVVAVKVIQSATSGGAYKRLIKECKTLGRIRHRNLVRMVGVCSSLHVKSVIMEFMSQGNLDKHLHCRENSCRLDLKRRLSILKDVAHGMAYLHHYCSPAIVHCDLKPSNVLLDETMTAHVGDFGISRLINDSAAAAASGDTSSHVIGSVGYIAPEYGTGGRPSMKGDVYSYGILVLEMITGKKPTDAVLSEEEQSLQSWVGDAFPDRLLEVIDRTLVEEIRMEEEDEEPESHDVSEFIGHGIVVLLAKIGVMCSKGDPHDRPTFREVEASLEQLVAKIHKNSENELNRLGQVTDEAISESD

SEQ ID NO: 901 - protein, 365 aa, Pinus radiata
MASLIGIVPLLLLLTLIPATESFNDTEALLQFRALTDSHGILAKNWSSADACTGKWQGITCKNGRVFFVSLSRHELRGPIDPLSALDQLRVLDLQGNRLNGSLDPLSNCYNLKLLYLASNDFSGLIPADLARLRRLVRLDASDNNLRGSIPPVIRNLTRLVTLRLQNNILSGPLPDLSFLGDLNVSNNELSGQVPRQLLEKFPASAFAGNAGLCGRSPFPACTIPPPVAVVVPSNPSSDPGSSTPVDTRSKTRALSTGAVIAIVVGDAAVLILITLIFLVYYWKKYVREAEVAGKTASEKMDFSGGAQTPEMEKSKLVFFDRKKQFELEDLLRASAEMLGKGSFGTAYKAVLDDGCVVAVKRLKD

SEQ ID NO: 902 - protein, 386 aa, Pinus radiata
SKLFWCLAALLCGICCCHSFSPAPSPVDFQEISGIQQCNQSDVQALISFKQTVSSSSPLNWEVNRSCCTWEGVTCGLLSLQQFSVTKLRLPGRRLRGTLSDSLGRLAHLREINVSFNLLTGEVPGRLFLLQHLEVLDLSFNNLSVIAPVAQGLNSIRTFNISSNSFRGNVPQLGSAVNLTSFNVSNNSFTGPIPVHICQNSSSLQYVDFSLNRFNGTLKEGLGQCRKLQALNAGFNSLAGPIPNDLYGMSSLRQLRLPFNQFTGTLRAEIGNLSNLSVLSLSANRLTGLIPLELGKLENLEGLILHSNRFTGMVPSRLSQCKKLKILNLKNNSLTGVIELNFTSLPELIYLDLASNNLSGSIPRHESTSRAAAGPSIFHPGGVPGK

SEQ ID NO: 903 - protein, 115 aa, Pinus radiata
MKCLVVLVLLSIVWSTGASNAEGEALNAFKQSLNDTNNSLSDWNVDLVDPCSSWSHVSCVNGHVATVTLTNMSFSGTISPQIGQLTFLTYLTLEGNSLTGSIPPELGNMTSLQNL

SEQ ID NO: 904 - protein, 599 aa, Eucalyptus grandis
MKRSSDLTILFWVAWLVTAVAAVEDDIQCLQGLKASLGDPQGKLSSWRFASSSVGFICKFVGVSCWNDRENRILSLELRGMDFTGQIPESLQYCRSLQTLDLSNNGLSGTIPPQICRWLPYLVTLDLSSNGLSGSIPPDLVNCTYLNNLVLSNNRLTGTIPYDFLTLSRLKKFSVANNDLKGTIPSFFKGFDKASFEGNDLCGGPLGKCGRLSKKNLTIIIAAGIFGAAASLLLGLGLWWWYHLRVVRRRRRRMYGIGRDDDSVWAERLRAHKLVQVSLFQKPIVKVKLADLMASTNNFSTDNIIISTRTGCTYKAVLLDGSALAIKRLNTCKLGEKQFRLEMNRLGQLRHPNLTPLLGFCIVEEEKLLVYKHMSNSTLYSLLHGSTVLLDWPTRFRIGLGIARGLAWLHHGCDPPFLHQNLCSNTIFIDEDFEARIVDFGLARLMTTSESSGSSFVNGDLGEFGYIAPEYPSTMVASMKGDVYAFGVLLLELVTGQKPLLVNNPNEEFKGNLVDWVNVLSSTDRIKDAVDQTLWEHGYDGEILQFLKIACSCINSRPKDRWSIYQAYQSLKSMAEEQGMTEQYDEFPLIFLKQDNEWM

SEQ ID NO: 905 - protein, 412 aa, Eucalyptus grandis
DSNMTSNEASENVTVMVSVEDTGIGIPLRAQDRVFMPFMQADSSTSRTYGGTGIGLSISKCLVELMGGHINFISRPQIGSTFSFTAVFGRCKRLVFANVKRTFEDLPSGFKGLKAIVVDGKPVRAAVTRYHLNRLGINVEVASSINAITATGGKNGSLTAGYRHPDIILVEKDMWMSSIDSWISLTVADWKQNGNLIQLPKILLASKISASELEKAKASGFADTVIMKPVRASMLAACLQQVLGIGRKKQLQKDMNMRNGSSALRSLLYGKKILVVDDNKVNRRVAAGALKKFGANVECAESGKAALELLQLPHDFDACFMDIQMPEMDGFEATRQIRLMESQVNEQMKSESAVQIVKGGEWHMPILAMTADVIHATYDECLKCGMDGYVSKPFDEENLYQAVAKFFRTKPV

SEQ ID NO: 906 - protein, 496 aa, Eucalyptus grandis
AVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETIMKSSNLLATLINDVLDLSRLEDGSFQLNIATFNLHAVFREVLNLIKPVASVKKLLITLNLAPDLPEYAVGDEKRLMQVILNVVGNAVKFSKEGGISITAFVAKAEYLREARPPEFIPVPSDNHFYLRVQVRDSGSGINPQDIPKLFTKFAHNQSLATRNSGGSGLGLAICKRFVTLMDGHIWIESEGIGKGCTATFIVGLGIPEKLNESKFPVLPRGSSNHVLANFSGLKVLVMDDNGVGRAATKGLLLHLGCDVTTVSSGDELLHAVSQEHKVVLMDICTPGIDSYEVAVQIHRLYSQHHERPLLVAITGSTDKVTKENCMRVGMDGVIQKPVSLDKMRNVLSELLECGHQMSSLARV

SEQ ID NO: 907 - protein, 155 aa, Eucalyptus grandis
MEVGQMQRRLVEFTKSLFMEGFLDGQFLQLQQLQDESNPDFVVEVVSLFFQDSEKLLNDLTSALEQQNVDFKKVDAHVHQLKGSSSSIGAQRVKNACVVFRSFCEEQNLEGCMRCLQQVKQEFYLAKNKFETLFTLEQQIVAAGGSIPAMEITSF

SEQ ID NO: 908 - protein, 124 aa, Eucalyptus grandis
MEVGQMQRRLVEFTKSLFMEDSEKLLNDLTSALEQQNVDFKKVDAHVHQLKGSSSSIGAQRVKNACVVFRSFCEEQNLEGCMRCLQQVKQEFYLAKNKFETLFTLEQQIVAAGGSIPAMEITSF

SEQ ID NO: 909 - protein, 1018 aa, Eucalyptus grandis
MMVCEMEKDPIEDMDIEALPSMWPEDIDNDAGKQFNIENPGGDEDMLKEVTIPEEPNIVDIKRLLELTNYTDQGASQLAYLVKHWEYRQANAVRLLKEELDILSRQRQEVELKKLEILEEHRFEGERYGGDKRPISILDDAFDIWQDVPRRKSDVVIQNKRVEIDAEYDTVIYWKQRAMHLEKLLEASIHREQALMEKLQESINNLEKQSSPVEELSQILKRADNFLHFILQNAPVVIGHQDKELRYRFIYNPYPTLNEEDVIGKTDIDIFTGAGVKESQEFKREVLEKGLPAKREITFDTELFGAKTFLIHVAPVFSKTGETIGINYMGMDVTDQVRIREKMAKLREEMAVRNAKETEMNKTMYITEETMRAKQMLATMSHEIRSPLAGVVSMAEILAQTRLDHEQRQLLDVMLSSGDLVLQLINDILDLSKVESGVMKLEATKFRPREVVKHVLQTAAASLRKILTLEGHVADDVPIEVIGDVLRIRQILTNLISNAIKFTHEGKVGINLYVVPEPSVEKTEECPQKSQADQSTPRENRGKEEKSSLVCQASCDQQPVQVKSQNGHLCQNHALHDNTRIMCESEESADRDKVEEHTPETTVWICCDVYDTGIGIPENALPTLFKKYMQVSADHARKYGGTGLGLAICKQLVELMGGRLTVSSREHVGSTFTFVLPYKVSPICDNSDDSDDLAIMANHDSAVDDITDGFFQFQPPTLGSLFSSNGSSRTQKLSSHNVGYTSINNLNRVAEDSYAFPTNNLRLKELASPEDACSAVDAAETSSETACSVSPSVHYECKVDVKNGKVNQLGTECRSQISSSNVSCLEVEKGQVDKLTISELPRSCPELEKSCASSESTSSSIVEEPKPKPKPKILLVEDNKINVMVTQSMMKQLGHSMDVVNNGVEAVHAVQQSTYDLILMDVCMPVMNGLQATRIIRSFEEMGNWDAAVNAGIELVSSDLSCNGHSSRESKERVPIIAMTANALSESADECFANGMDSFVSKPVTFQKLKQCLEQYLM

SEQ ID NO: 910 - protein, 154 aa, Eucalyptus grandis
MGMAAAESRFHVLAVDDNIIDRKLIERLLKTSSYQVTTVDSGSKALEFLGLHEDDRSNSVSPSISTNNHHQELEVNLIITDYCMPGMTGYDLLKKIKESSSLRDIPVVIMSSENVPARISRCLEEGAEEFFLKPVRKSDLNRLRPHVMKAVSKD

SEQ ID NO: 911 - protein, 942 aa, Eucalyptus grandis
MGRRRRDLPLLALLLPLLLLLLLLLCLAASAQTVQSDVDAMQALKKSLTLPSSLDWSDADPCKWPQVSCTGNRVARIQIGMRGVSGTLPPDISSLTELTRFEVMNSQFSGPLPSFAGLAQLQVLLLNRNNFTSIPADFFTGMSSLQAVDLSYNDFAAWGIPASLKDCISLQNFTATQANVIGQIPDFINVANFPSLIALQLAFNNLEGGLPASFTGLTIQILWLNGKAGNSQLNGTINVIASMTQLAQVWLHSNQFTGPIPDVSNLKNLWDFSVRDNQLTGVVPESLMKLPSLKVVNLTNNLLQGSMPAFNTKAVQVDMTGTNSFCSSNPGIPCDPTVNILLSIAQPMGYPVKFAQGWQGNSACNSWTGILCSGGNIDVINFQNMGLSGTIAPEYSNLTSLQRLLLSHNSLTGTIPSELTTLPNLKVLDISYNNLSGKVPTFRSNVNIIKDGNPNIGKDIAPPASPTTTPPGSPGSVGSDNKKSSVARIVAPLVGGASLIALLGLVFWYRKRPKSSGKVQSPNNVLVIHPRHSGDQNGVKITVAGSSANGGSSETHSQGSGGTGDIHVVEAGNMVISIQVLRNVTNNFSQDNILGRGGFGTVYKGELHDGTKIAVKRMESGVISEKGFNEFKAEIAVLTKVRHRHLVALLGYCLEGNERLLVYEYMPQGTLSRHLFNWKDEGLKPLEWTRRLSIALDVARGVEYLHGLAHQTFIHRDLKPSNILLGDDMRAKVADFGLVRLAPEGGKGSIETRLAGTFGYLAPEYAVTGRVTTKADVFSFGVILMEMITGRRALDETQPEDSVHLVTWFRRMHLNKDTFRKAIDPVIDLDEETLASVSTIAELAGHCCGREPYQRPDMGHAVSVLSSLVELWKPSEPDSEDMYGIDLEMTLPQALKKWQAYEGNSNIDESSSSFLASNESTQTSIPTRPSGFASSFTSADGR

SEQ ID NO: 912 - protein, 800 aa, Eucalyptus grandis
MAPPSSLLLPLFLSLFLQSCRLSTSAPPSLPKRASLSVENPDDLLVSPSGAFSAGFFPVGHNAYGFAVWFSHPPCSGAACTPVWMANRQAPVNGRRSTLSLLNSGSLVLTDAGAEVWSSGTSSPSAAELRLNDTGNLFLTDGSGGVLWQSFDSPTDTLLPQQPFTGKTFLISARSRYNYSTGFYKLYFDPNNVLRLLFDGPSISSVYWPYPWFSNDQLGRFPYNSSRIAVLDLLGRFQSSDNYSFSTSDYGVTAMQRRMTLDFDGNLRVYGRELGSTVWAVTWEALSIPCFIHGVCGNNSLCSYDPTQGRSCSCVPGYVPKVPGDWSAGCVPDFTFSDGCVADDIRFVKLQYVDFYAYDYNISFNTTLAKCRQTCLNLCNCRGFQYSGSRSGGMSDCYPKIELLNGHNLPSFPGEFFIKVPKNKTFTVDQLVKRTQYTCPPTQEEKVPHRSKDGGLSFMLWFACVVGGIEIVVVFLVWCFLIRNQQDVTSAHQSYLNTAAGFKWFSYDELKKATRNFSKEIGRGAAGIVYKALLPDDRVVAVKVLSNATTGEADFLAEASTIGRVNHMNLIGMLGYCAEGKRRLLVYEFMEHGSLAQNLSSPELHWKRRYDIAVGTAKGLAYLHDECLEWVLHCDVKPQNILLDSDYQPKVADFGLSKLMDRGKVRNSDFSRIRGTRGYMAPEWISNLPITSKVDVYSYGIVMLEMVTGISPMTSVQSLQSGGDAKQIWLVPWVRNKIKGPRRTGSRLKKMVHPELRGDYNLKQMEVLIEVALKCVEEDKNARPPMSQVVEMLLRHENDS

SEQ ID NO: 913 - protein, 541 aa, Eucalyptus grandis
MPRPTPSPPHIHIFFLSYIPCLVFLCLLSNAAESQIQDQEQQVLLKLRQSWRDPSSLDHWVASNSSSHCTWPEITCQEGSISELNLVNLNINYSIPPFICDLKSLTKLDISYNNIPGGFPTVLYNCSKLVYLDLSQNYFEGPIPSDINRMANLQVLILAANSFSFNVPASVARLRRLRILHLNQSEYNGTYPEEIFGLSNLEELSLGYNDKFVPSQLPQNFTSLKKLRFFSMPQTNLYGGIPETISDMEALEHLDVGINPLTGEIPGSIFALRNLSKLYVYNTNVSGSIPQSVSAANLSRIDLSFNNLTGNIPEDFGKLKNLSCLSLQFNQLSGGIPEGIGRLPALSDVRLSKNNLSGTIPPDFGKFSPLRRFEVAFNSLTGALPEQLCHGGTLFGLAVMDNNLGGELPESLGNCSTLSVAMLNNNGFTGNVPGGLWMLRNLTALILSGNGLTGELPEELSPNLTRIEMSNNKFFGKIPSTVSSWKNLVVFDASNNLLSGTIPTELTKLPFSGGAFARSERALWESSDSHCFVELLEHSES

SEQ ID NO: 914 - protein, 998 aa, Eucalyptus grandis
MFLSFLSFLLLLLAGAAAPPALSLNQEGLYLHGAKLSLSDQDSSLAAWDDRDASPCGWPGVGCDRASGSVVSVDLSGANLGGPFPLLLCRLPNLTFLSFFNNSITSLPAGVSACRSLVHLDLGQNLLAGDLPASLADLPGLAYLDLSANNFSGDIPASFGRFPRLEVLSLVNNLLDGAIPGFLGNVSTLKMLNISYNPFAPGRIPPELGNLTNLEVLWLSECGLTGKIPESLGRLKRLTDLDLAFNYLEGPIPSSLTELESVVQIELYNNSLTGELPAGLSKLTALRLLDASMNRLTGTIPDELTRLPLESLNLYENQFSGELPASIADSPNLNELRLFNNRLTGKLPKNLGQNAPLQYIDVSTNNFSGEIPASLCANGELEELLMIENSFSGPIPEALGRCQRLTRVRLGNNRLSGEVPSSFWGLPRVSLLELADNKLSGPIGEEIARASNLSVLSLSRNEFTGPLPKGIGTIVRLLDFSASENKLTGSLPESILNLGQLGRLDLRSNDLSGELPSGIRHWKKLNELDLADNRLSGSIPAEIGGLSVLNYLDLSGNQFSGKVPAELQNLKLNQLNLSYNSLSGPLPPMFTKQMYKNSFLGNPGLCGGEMKGLCNGGGEERNSGYVWLLRSIFILAGLVFIVGVGWFYMKYKSFKNAKRAIDKSKWTLMSFHKLGFSEDEILDCLDEDNVIGTGASGKVYKVVLSSGDAVAVKKLWDGPRKESESHDVEKGPVQDDGFDAEVKTLGKIRHKNIVKLWCSCTTRDCKLLVYEYMPNGSLGDLLHSSKGGLLDWPTRYRIAVDAAEGLSYLHHDCVPPIVHRDVKSNNILLDADFGARVADFGVAKVVERTGKGHESMSVIAGSCGYIAPEYAYTLRVNEKSDTYSFGVVLLELVTGRRPVDPEFGEKDLVKWVCITLDQKGVDQVIDRKLDSCFKEDVCKVLNIGLQCTSPLPINRPSMRRVVKMLQEISAENAPKKVIKDGKLTPYYYDDASDPGSVA

SEQ ID NO: 915 - protein, 827 aa, Eucalyptus grandis
MDSKNSSPWSFILPIFLLCSSLYTHLCLGTDKLDANRSISGNQTLTSSGGNFTLGFFSPGNSTYSYIGIWYNKNKISVQTVVWVANRDNPVTDRHSTGLKVSGGNLVIVNNSEVPVWSTNLTASSSGSSSMVAVLEDDGNFALKAAPNSSVTLWQSFDYPTHTWLPGAKFGIDKRKNTSQRLTSWKNAEDPSTGLFSLNLQPFGEYYIWWNRSKHYWTSGTWDNQTKIFSLVPEMRANYIYEFKYVDNENESYFTYSIKSSFNTISRFVMDLSGQIKQESWLPSQAWTMFWSKPSQQCDVYRLCGPFSVCSEQSEVLCNCLPRFSISSPVDWNRRDWSGGCKRNSNLNCAANAEKDRFWPMSNMKLHDAPQSLVAESDQECRTACLSNCSCTGYAFENNACSIWIGDLFNVEQLKQGTTPGTSFYVRLAASDIKDPSKKSKVTAIVAGSVSAAVAILAIVSFAIWRWRRGATVTTKEVEGSLIAFAYRDLQVATKNFSEKLGGGGFGSVFKGTLPDSSHIAVKKLESISQGEKQFRMEVSTIGTIQHVNLVRLRGFCSEGDKRLLVYDFMPNGSLDYHLFHRKDSKALDWKTRYQIALGTARGLAYLHEKCRDCIIHCDIKPENILLDAEFCPEVADFGLAKLVGRDFSRVLTTMRGTRGYLAPEWISGVAITVKADVYSYGMMLFEFVSGRRNLELSENGAIEFFPTWAASKIAKGGDLLDLLDPDLEKNADTEELNRICRVACWCVQDEETHRPSMGLVVQVLEGLLDVNLPRIPRALQLLLDNQEHVVFFTESSSSDQNSQTNSNTSTSSLQNPNSSSWTKSES

SEQ ID NO: 916 - protein, 633 aa, Eucalyptus grandis
MKLLQAVIPTTSLLFGVLLLIPLVVADLNSDVQALLGFASAVPHARKLNWSPSIPICSSWVGITCNVDKTRVTKVRLPAVGLYGSLPSNTLAKLDALEVLSLRSNYLTGNLPSDVASIPSLQYLFLQHNNFSGSLPISLSSQLNVLDLSFNSFSGGIPPSIQKLNRLAIFYLQNNSISGTIPDLNLPKLKLLNLSYNNLSGSIPNSLQKFPNSSFVGNSLLCGQPLSQCSTLATSPSPAPAHSEQPTTGPFGQKVASKKKIGSGAIIALVIGGFAVLFLLMVVVLVYYSKRKDGSNVLKVKGTNGTSQNPKDFGSGVQEPEKTRLVFFEGCSYNFDLEDLLRASAEVLGKGRYGTAYKAILEDGTTLVVKRLREVVAGKKEFEQQMELVGKVGRHANIVPLRAYYYSKDEKLLVYDYMPYGSLFVHLHGDKGSGRTPLDWNSRMKISLGTAKAIAHIHSEPGAKCVHGNIKSLNVFLTQDHDGCVSDVGLTPLMNLSAITPRVIGYYAPEVIESRKVTQKSDVYSFGVLLLEMLTGKTPLKHPGHDDVIDLPRWVRSVVREEWTAEVFDVELLKYENVEEEMVQMLQIALTCVTKVPDMRPKMDEVARLIDEVREPEAKDRPSSGAESNAQTP

SEQ ID NO: 917 - protein, 628 aa, Eucalyptus grandis
MFSLFFLLLLPLLSASAPVPHPYGNVSYHIDCGGNSPVVDSFNTTWLPDRYFTGGAAAVVSEPLRFRQPQEKTLRYFPLSSGKKNCYVLPGLPSGRYYLRTFTVYDNYDGKSHPPSFDASVEGTLVFSWRSPWPSPDLAGGSGAYSDLFAFVRDGEADVCFYSMATDPPVIGSLSLVQVDPLSYDSASVGTNFILVNYGRLDCGDGQWGPGFSDDADYFGRSWQSDYSARTAATRKIIDAISTASSIAGTNRQPNYFPMKLYQTAVTVGQMGALEYELEVDAKLDYLLWFHFAEIDPGVNKAGQRVFDALVNGANATRIDIYKEVGRFAAFDWHYTVKNLSTTVLNVKLVPVVGAPLLSGIENYALVPADLATDPQQVIAMRSLKESLRVPDRMGWNGDPCAPTNWDAWEGVTCHTNKDKTALVIYQIDLGSQGLKGFISDQVALLSNLISLNLSSNSLGGNLPSGLGQKSLVRLDLSNNQFVGSIPDSLTVSNLQLVLLNGNQLEGRVPEEVYSIGVHGGEIDLSDNKGLCGVPTLPACPLFWQNGGLSTGGKIGIAISCLVVFSVLLVVVYICCIRRGRHDYDFALPHELMALSAKRNRYQRQKSLMVLEMESQHAKILPSNLSPH

SEQ ID NO: 918 - protein, 685 aa, Eucalyptus grandis
MTLSLLLSLLFSLAFLHCCRHPPRALSSPLSELHALMALKAALDPSGRVLTSWSRGADPCGGGASFEGVACDERGRVVNVSLQGKGLRGRIPPEIGGLGSLTGLYLHFNALGGEVPGEIGGLRMLTDLYLDVNGFSGEIPPDIANLTNLQVLQLGYNRFSGGIPRQLGSLPKLTVLALQYNRLTGAIPASLGDSANLKRLDLSYNNFFGSIPATLTNASSLEVLDVRNNTLSGYVPTGLKRLDDGFQYENNPDLCGVGFPNVRPCPTVYLDRPEPLRPDTLSKKNIPESADLNSTCGKAHCPNRLSGRRAGVVLGVVAVVAAIGFAVVGFLTLSWHQHRKQRNSSSVDVLDKRVRASRALENRSKRASALISLEYSNGWDPLAKGGGGSAFSQEVFENFMFNLEDVERATQSFLESNLLEKSSFSSVHRGILRDGSTVTVKRYAKMNCKSDEAEFLKGLKLLTKLKHENLVRLRGFCCSKGRGECFLIYELVPNGNLLQYLDAKPGSGKVLEWHTRVAIIIGIAQGISYIHEDEGDKPRLVHQSISAEKVLIDYWNNPLLSDPGLHHLLADDVVFAMLKASAAMGYLAPEYASTGYLTEKSDVYAFGVLVLQILSGKRVITPSIRHGVEACCFDEFIDENLEGNFLETEATQLAQIALLCTRDSSIDRPLMRTVVQELDMLIGIS

SEQ ID NO: 919 - protein, 984 aa, Eucalyptus grandis
SLLSLKSSLRDPHSTFHDWDPTPTFSNPTLQNPAWCSWSGVKCNPQTSQITSLNLSRRKLSRAIPAEIRYLTSLLHLNLSGNAFDGILQPAIFELTELKTLDINHNNFNSTFPMGISKLKLLRAFNAYSNSFTGPLPQELVSLQYLEYLNLGGSYFEGEIPSDYGNFPRLKSLFLHGNVLEGPIPPELGSLAQLERLEIGYNQYYGGIPSELALLSNLRYLDISAANLSGSLPQELGNVTKLETLFLFGNRLTGQISRSFSSLEALQALDLSDNQLSGTIPEGLGSLKQLATLGLMKNNLSGEVPQTLGVLPLLETLQLWNNSLTGILPQGLGSNAKLTKLDVSSNSFTGPIPPNLCLGKKLIKLLLFSNRLVGAIPPSLANCTSLYRLRMQDNMLNGSIPRGFGLLPNLTFADLSNNFFSGEIPDDLGNGVALQYLNVSGNSFGTKLPDNIWKAPNLQIFSASSSKLLGKIPDFIGCKSLYKIELADNSLNGSIPWDIGHCEKLLYLNLSRNSLAGIIPWEISTLPMITDVDLSRNFLTGSIPSNFDNCTTLESFNVSFNSLTGPIPSSSTIFRNLHPSSFIGNDGLCGGVLAKPCGGGRGADASGMDDSEAGQQQPRRTAGAIVWIMAAAFGVGLVVLIAGTRCFHATYSHRFIERQGVGPWKLTAFQRLNFTAEDVVECLSMSNKIIGMGSTGTVYRAEMPGGDIIAVKKLWGKPKEHMRKRRGVLAEVEVLGNVRHRNIVRLLGCCSNRECTMLLYEYMPNGNLDDLLHGKNKDLNLVTSWVTRYKIALGVAQGICYLHHDCNPVIVHRDLKPSNILLDAEMEARVADFGVAKLIQSDESMSVIAGSYGYIAPEYAYTLQVDEKSDIYSYGVVLMEMLSGKRSVDREFGEGNSIVDWVRLKIKSKDGIRDVLDKNTGASCAPVREEMLELLRVALLCTAASPADRPSMRDVVLMLQEARPKRKLLDDMSGDDSVPLTKKS

SEQ ID NO: 920 - protein, 645 aa, Eucalyptus grandis
MHVTVYRRRGELAAALRLVLRSWSLLCCCCCFFLLPLALAADGDYEILLRVKAAHLEDPDGQLDDWAPNADRSPCNWTGVTCETRNRSVVAIDLSGLNLSGGFPYDFCRIRTLRNLSLGFNFFNGTVVGPSLSLCSHLQGLNISSNIFVGELPDLSPGFTDLRFLDLSLNNFSGEIPASFGRLPALSVLSLVANLLNGSIPSFLGNLSQLTQLNISYNPFVPGPLPPEIGNLSRLENLWAAGSYLVGEIPSSIGKLTSLKNFDLTHNMLSGKIPDAIAGLRSVEYIELYDNHLSGELPEGIGNLSNLLQLDVSQNGLTGVLPEKIAASPVTSLNLNDNLFNGEIPAVLASNPNLQQLKLFNNSFTGKLPADLGKKSGLVEFDVSTNSFTGELPENLCSRGKLQKVIVFNNRFTGRLPSSLASCDSLEYVRISNNELSGEVPAGFWGLQAVWYLDMSYNKFEGAISRSISGPKGLQSLLIAGNKFSGDIPAEICQLLNLTVVDVSNNRFGGGLPTCITNLGSLQKLKMQGNLLTGPIPSSVGPWARLAELNLSNNRLTGSIPAQLGDLPVLTYLDLSGNSLSGEIPTELTKLTLNKFNISHNKLYGEIPPGFDHELYVSGLTGNPNLCSSDLKPFPKCTRARPVAF

SEQ ID NO: 921 - protein, 974 aa, Eucalyptus grandis
MAATAAKPPCKPASYFCFSSSFCLLLFVSASLAQSDLDVLLQLRAALAAPNSTALHDWVGPSSSSSSSSSPPPFPHCSFTGVTCDAGSRVVSLNLTDVRLFGRVPREIGLLRDLVNLTLTSCNLSGTLPPELGNLTELEVLDVYDNNFTAQLPPEVVGLKKLKWLNLAGNYFFGEIPEVYSEMESLEYLGLQANQLSGRVPASLAKLKNLQWLYLGYFNTYDGEIPAEFGSMKELRRLDLASCGLSGEIPVSLSELKKLDSLFLQWNNLMGVIPPELSKMLSLMSLDLSNNYLTGVIPATFAELKNLTLLNLFANHLEGQIPEFVGELPNLETLQVWGNNFTMMLPAGLGRNGRLLYVDVTQNHFTGTIPRELCRGGRLKTLILTNNSFFGPIPDEFGECKSLTKVRVGKNFLDGTIPRGIFNLPQATIIELNDNLFSGELPAQMSGENLVILSLSNNRISGEIPPAIGNFSGLRTLLLDANRFSGKIPSELFSPRFLLRVNISGNSISGRIPGSVTGCTSLAALDLSRNNLAGEIPNGLSSLKVLAVLNLSSNRLTGPVPKEIGIMTSLNTLDLSFNDLSGEVPHEGQFLVFKNSSFAGNQKLCSPGRFSCPSRSSASRTSSRVVITAISLVTAALLITVTVYQVLKRRRQGSRAWKLTAFQKLGFKAEDVLKCLEEENIIGKGGAGIVYRGSMPNGTDVAIKQLAGRGGNGLSDHGFSAEIQTLGRIRHRNIVRLLGYLSNKDTNLLLYEYMPNGSLGELLHGSKGGHLQWETRYRIAVEAAKGLCYLHHDCLPLIIHRDVKSNNILLDSDFEAHVADFGLAKFLQDAGASECMSSVAGSYGYIAPEYAYTLKVDEKSDVYSFGVVLLELIAGRKPVGEFGDGVDIVRWVKTASDPLPQPPSDAALVLAVIDRRLGGYPIASVIHLFKIACRCVEEESSERPTMREVVHMLTNPPLSATTFAVGATPDLIKL

SEQ ID NO: 922 - protein, 825 aa, Eucalyptus grandis
MNPPSMSPVSIHHTLFFLLFLIPRPSLAQENIPVGSSLTATNGNSSSWLSPSGDFAFGFHSLSDGDTKKNQLFLLAIWYNKIPSKTIVWFANEDRPAPENSKLTLDSDSGLVLTNPQGGELWKPDTVIGTVSHAVLNDTGNFIILDSSSDVKWQSFDNPCDTLLPSQVLGKGKSLSSRQSEESFSRGRFQLRMRESGDLVLNTINLPSDYANEAYYSTGTDGSSNASTAGKELVFSNSGSLFVSRANGERLLLSQGGISPASDSYHRVTLNFDGVLTQYVHPKNSGSSGSWATLWSQPDDICAKVQVRDGIGVCGYNSICTMGENNRPKCDCPEKFTLLDPSDKYGSCRPNFTQSCADDQERTKLGPMEDLYGFEELMNTDWPTSDYALLQPFGEEECRNSCLHDCMCAVAVWRDGQSCWKKKLPLSNGKIDPTLNGKVMIKVPKRDFRPTYFPLPEPKARDKEPKSLVLVGSVLLGSSVFVNFVLFGACMVFFLIYRKQLKKVSTKGNVVETNLRHFTYQELFRATDGFKEELGRGAFGIVYKGVISNNVAVAVKKLSSMMQDKEKEFRTEVNVIGQTHHKNLVRLHGFCDEGQERLLVYEFLSNGSLSDLLFAGDPKLKTPWNLRCQIAWGVARGLMYLHDECPTQIIHCDIKPQNILLDNNCVAKISDFGMAKLLMMNQSYTKTNVRGTRGYVAPEWFRNLPITVKVDVYSFGVLLLEIISCRSCLASESSGEEREIDALTDWAYDRFMEGRLDALVEGDAQALQDTEKLKNLVMVAFWCIQEEPSLRPTMRKVTQMLEGAVGVPDPPCPFPFSSCNTAIVP

SEQ ID NO: 923 - protein, 823 aa, Eucalyptus grandis
MNPPSMSPVSIHHTLFLLLFLIPRPSLAQANIPVPSSLTATNGNSSWLSPSGDFAFGFHSLSDGDTKKNQLFLLAIWYNKIPSKTIVWFANEGRPAPENSKVELTSDSGLVLINPQGDELWKPGNVGTVSRAVFNDTGNFMILDSSSEVLWQSFNDPCDTLLPSQVLGKSKSLSSRQSEESFSRGRFQLRMLESGDLVLNTINLPSDFANKVYYSTGTDGSSSASTAGKELVFSNSGSLFVSRANGERLLLSQGDIPPASDSYHRVTLNFDGVLTQYVHPKNSGSSGRWATLWSQPDDICTDVYVENGIGVCGYNSICTLRENKRPKCDCPEKFTLLDPSDKYGSCRPNFTQSCTEDWERLKHGPMEDLYDFEELMNTDWPTSDYDLLRPFREEECRNSCLHDCMCAVAIWRDGQSCWKKKLPLSNGRIDPNLNGKAMIKVPKRDFSPSYFPPPDPKAKDKDPKTLVLVGSVLLGSSVFVNFVLFGACMGSFLIYRKRLKKVSTKGNVVETNLRHFTYQELFRATDGFKEELGRGAFGIVYKGAISNNVEVAVKKLTSMMQDKEKVFRTEVNVIGQTHHKNLVRLLGFCDEGQERLLVYEFLSNGSLSDLLFAGDPKLKTPWNLRCQIALGVARGLMYLHDECPTQIIHCDIKPQNILLDNNCVAKISDFGMAKLLMMNQSYTKTNVRGTRGYVAPDWFRNLPITVKVDVYSFGVLLLEIISCRSCLASESSGEEREIDALTDWAYDRFMEGRLDALVEGDAQALRDTEKLKNLVMVAFWCIQEEPSLRPPMRKVTQMLEGAVGVPDPPCPFPFSSCNTAIVP

SEQ ID NO: 924 - protein, 715 aa, Eucalyptus grandis
MKVVQQLLLVAVAWWLRQGGAPTVAGNCAHRCGRVPIPYPFGLEPQCARSKEFLLYCNTTDGSGGQLLLGNIPIRKISVGDSTMLVSLPELHECYNKTGQLVSSTDNLYINLTSYPPYRVSATRNNLTVLGCDTYVLMTDRYGLFRSGCISYCSEYVDLAKETTCSGLGCCQASIPKGLKMLRIRISSVDGHVSVPFNPCGVAFAVDKMSFNLSSRRLPTLNDLGKRADLVLDWMIGWDVTCAQAMSNQSSYACGENTYCDYFADGPGYRCFCKSGYEGNPYDRSRGCQDINECKDSQKYPCHGKCENQPGNYTCDFVKNGTGNNATDGDSDNRRDIALTMILAPVVCIYAGASASVTWKWKIRKINFRRNGGKHLKRQGVKIFTEAELAKATNNYDESKKLGEGGFGSVYRGRIAVDVEVTVKKPKDVHKPLMKKGFQDELKIVTQTKYKYVARLYGICLETRIPLLVYEYILNGTLFEHIHLKMSTILRSWENRLRIAAEVALALKEMHSSEIIHGNIKSMNILLDQNYSVKISDFGTSVLISPEHSHLIATEIEGTLGYIDPEYLTTGKLTIKSDVYNFGVVLVELLTEKKPTSSVTDKYGEPINIIPHFISSVKDKSLSGVINFEAASEDEIKQVETLAKIAVKCLDHNSRKRPTMSEVAQKLPPINRSSTVAVDNKEPNFKVPGPICPTVKIPVTDCLSCLGLEQVCSCS

SEQ ID NO: 925 - protein, 611 aa, Eucalyptus grandis
MRSSVPSLFLLFLCFAHGTADPTDNGPCPPQRCRRHHGPLVQFPFLLERKGQHDDCGYSRDFHLSCDQSGNTLLSLPGTPRPLVVTDIDYEGSSISVRDRDGCIPLPLANLNHSIFSYEKSQPSQYSSYQPPYNYTLFQCPRDGRSEGRMTRLDCQSTSAYDVFAVESYSYVGDLPLVSCMRSGSIDLLPKMISMMGEVNLVWEKPDCRLCTKNGSLCRGNENGIRCINPPGGYKERRKLEIAGGVVGFFLFLVVLSGLSYVINEKRRDKAFQLKIESFLHDYEALKPTRYSYNDIKRITNDFEEKLGQGAYGTVYKGKLSNEIFVAVKMLDNSFGNGEEFINEVSTMGRIHHVNVVRMVGFCADGFRRALVYEFLPNESLEKFIFQGEDALDPFLSWERLHDIALGVAKGIEYLHQGCDHKILHFDIKPHNILLDNNFNPKIADFGLAKLCSKEQSAVSMTAARGTMGYIAPEVFSRNFGSVSSKSDVYSFGMLLLEMVGGRKNVDVNAKNMSQMYFPQWVYNHLNKDEELEIRIREDGDRKIAKKLAIVGLWCIHWYPADRPPVKAVVQMLEGDEYPVMPKNPFVSSGSGDAAIMRGRLWNTDLEVIVE

SEQ ID NO: 926 - protein, 798 aa, Eucalyptus grandis
MKAFVALSMCPVLFFSCNALLSNALDTITTNQSIRDGENLLSAGGTFELGFFSAGNPPKRYLGIWYKKITTTTIVWVANRVAPLADASGTLRITSRGSLVLLNGNGSDIWSSNSTILVRNPVAQLLDSGNLVVRDADGSDPNNVLWQSFDYPTDTFLAGMKIGWNRTSGFNRYLTSWKSIDDPSPGNFTYQIDPNGYPQLLLKQGSDIKFRSGPWNGLRWSGTPNLNPNPYYRYEFVLNEEEMYYRYELLNSSVITRKLLMPNGMVQRFTWIDRTHGWTLYLTAPIDQCDNYASCGAYGTCRVDTSPVCRCLKGFVPRFSQEWDILDWSNGCVRRNPLDCEKDIFVKYSWVKLPDTRSSWFNESMNLQECKVVCMKNCSCMAYSNLDIRNGGSGCLLWFSELIDIREYNNYGQDLYIRMAASESALLPSPQKKHKLVMGLAVSFGSVFLILVLIICVRQCKKKKMEIPEGDNCENQKKDLELPLFDLSTVALATSYFSTDNKLGEGGFGPVYKGVLRGGQEIAVKMLSRNSRQGLHEFKNEVLYVSKLQHRNLVKLLGCCIEEENILIYEFMPNGSLDSFLFDPTQREQLDWSACFNIINGIARGLLYLHQDSRLRIIHRDVKASNVLLDYEMNPKLSDFGLAKSFTGNETQANTNRVVGTYGYMSPEYALDGVFSTKSDVFSYGVLVLEIVSRKRNRGFHHPDHDHNLLGHAWRLFTEGRSMQLLDQLVANSCSTSEALRSIHIGLLCVQQCPDDRPSMSTVVMMLGSDIELPLPKKPGFFNERNLLQENSSQSQPN

SEQ ID NO: 927 - protein, 629 aa, Eucalyptus grandis
MNLNTMRLKRGEEAALCLVAFLWIWNSANGLLSPKGVNFEVQALMRIKDCLHDPHNVLENWDKDAVDPCSWTMVTCSTDSLVVGLGTPSQSLSGTLSPSIGNLTNLQIVLLQNNNIMGPLPPELGRLSRLRTLDLSNNFFTGEIPSSLGHLNSLQYMRLNNNSLSGAFPSSLANMTQLQFLDLSYNNLSGPVPRILAKTFNIVGNPQICATGTEPDCYGTQLMPMSMSLNTSQTLPSSKRENHKVAFALASSIGCVCLIILAFGILLWLRQRHNQPTFFDVKDGHHEEASLGNLRRFHFRELQIATNNFSSKNILGKGGFGHVYKGVLQDGTLVAVKRLKDANAVGGEIQFQTEIEMISLAVHRNLLRLYGFCITPAEKLLIYPFMSNGSVASRLKGKPVLDWGTRKRIALGAARGLLYLHEQCDPKIIHRDVKAANILLDDYCEAVVGDFGLAKLLDHQDSHVTTAVRGTVGHIAPEYLSTGQSSEKTDVFGFGILLLELITGQRALEFGKAANQKGAMLDWVKKIHQEKKLEMLVDKDLRSNYDRIELEEIVQVALLCTQYLPAHRPKMSEVVRMLEGDGLAERWEASQRVESNKGKPHEFSSSDRYSDLTDDSSLLVQAMELSGPR

SEQ ID NO: 928 - protein, 547 aa, Pinus radiata
MGGLLHLTVLAVAVFLMVSLSQCGFELNDEVLGLIVFKADLHDPKSSLASWNEDDNSPCSWAGVVCSAKTGRVTEVVLDNLSLSGKIGRGLTRLPSLHTLSLANNNFSGDINISADLAQIPSLRIMNLNHNAFSGAIPAELFQQCDTLRVISLSHNALQGALPSSLSSCSSLTALNLSANHLSGSLPGSIWSLKNLRSLDLSHNSFSGAVPAGIGGLSSLREIHLNNNNFSGPLPADLGDCSLLRNLDFGHNLFSGGLPDSPKGLNFVSAMSFSTNMFVGTIPSWIGSLRVLESLDLSSNSFTGELPNLSSLQNARLINVSYNNLSGPIPESLLGCSRLYSVDFSRNGFTGSIPGELFQLGLQNIYLSWNSLTGSVPQAGSPKLYQFLEELDLSHNRLSGEIPPSITQCSNLKRLSMSDNLIASKIPSEIGNLKSLVFLDLSYNHLFGAIPARLGNASALSVLQLDGNSLSGRIPAEIGECSSLVLLSLAHNSLTGNVPKELAKLSRLTKLNLAMNNFTGELPQQLGNLGHLLSVNISHNKLKAGYQ

SEQ ID NO: 929 - protein, 523 aa, Pinus radiata
MDKIPYGEWSRWIAFGSFLLVVNVISEPEGFLSITCGGEMNTTHNGITWVGDAHYIDVGNTAEITDLSENAYGSYLHTIRVFPKPLNKSCYQLPVVPDVPYLLRLWFALGNYSGFQQWPSFTFSVETLGLLASQNVSFTDTDTDIYYYEYVFVSSGKVLHICFIRTSDPDDPFINAIELRTLKVGMYHAAAKPGTLLPLTRRQNVGGSTVIRYPGDNFDRIWTPRTPPTNKNLVVAVTTTHPISSDNTDDFPPYAVLKTAWVVNSSESNDIIFHLGSVLGKKTMLLLYFAEIETLNKPESRSFSVKINDVYRTPDIVSLVLNYSAVELAFQTNDISTSDFTFALDKANSSTLAPIINAFEYYWVIDTQPPTYSKDVEALIAIKSKFGIINWISDPCYLIHWEGISCDNSSSDIRISELNLSGGNLTGSIPADIGQLTALINMSLDNNYLMGSLPNFSNLAFLERLYLQNNNLSGSVPEWLSELKNLKELFIENNNFSGVIPAQLFNKLINNSLKMNYSGNPNL

SEQ ID NO: 930 - protein, 312 aa, Pinus radiata
MGNRHQMLLLLSSFLLLVAVRTEAQDSQPNITGYTCTNSSSTCETYVFYRAQAPNYLDLLNISSLFGVQRVQIATNSNLSTTTISVADGQSLLIPITCGCMGNYSQANITYTIFQGDTYYKVSTGNFENLTTYQAVEVANPTLNPTDLQIGVQVIFPIRCKCPSQAQVKNGTKMLITYTVQPVDTHNLSSITKKFGSDLQNFKSLNGMNSTLTAYTTVLVPVSQRPVLSQPVSSSPPPPPPPPPPAATSGNNTTSGGGSNKGVVIGASLGGAVALVCVALLVFCVLRNRGRSHKQTSISEGPKPPVPCDREY

SEQ ID NO: 931 - protein, 998 aa, Pinus radiata
  VARIANT (1)...(998): Xaa = Any Amino Acid
MSRAGYLHFLFFCFVLTVRSCFAIRGWQDGLILQELKRGFDDPSGAFRNWNENDNSPCNWTGITCDAGEKFVEEVDLSSKNIIGPFPTVVCRIDGLKKLSLANNYVNGSIPAGLRRCHGLEYLDLSQNLIIGGLPDFISELFRLKHLDLSGNNLSGPVPPAFGRLPELQVLNLVSNLLNTTIPPFVGDLPNLLQLNLAYNPLTGTVPPELGNLKKLQNLWLAGCNLVGEIPETLGNLSELTNLDLSMNRLSGSIPESITKLDKVVQIELYQNLLSGPIPVAMGELKALKRFDASMNMLDGSIPAGLGSLNLESLNLYQNNLVGEIPPGLGSFTSLKELKLFSNSLTGSLPENLGRNSDLLALDIADNLISGRLPPDLCKNKKLEILSIFNNELGGNLPESLGTCTSLNRVRLGGNKFNGSVPSLFWGLPHVSLLELKDNYFEGFISPDIADAKNLSXLVISGNIFSGSLPTEISELRNLSEIIASNNLLTGALPSSLGKLQLLGKLDLSNNQLSGELPAEISSCKQLGEINLSKNQLSGSIPASVGTLPVLNYLDLSDNLLTGPIPSELGNLKLNTFDVSDNRLSGAVPLAFENPVYEKSFLGNPELCSREAFNGTKSCSEVRSEKAKRQRWWWLLRCLFALSIIIFVLGLAWFYRRYRNFANAERKKSVDKSSWMLTSFHRLGFSEYEILDCLDEDNVIGSGGAGKVYKATLSNGELVAIKRLWSNGKTNASTDNGFQAEVDTLGKIRHKNIVKLWCCCSKSDSNLLVYEYMPNGSLGDLLHGPKASVLDWPIRYKIALGAAQGLAYLHHGCVPSIVHRDVKSNNILLDEDYGAHVADFGVAKFLQSCGSGADSMTAIAGSYGYIAPEYAYTLKVNEKSDIYSFGVVILELVTGRRPVDPEFGENKDLVKWLCNKIETKNGLNEVLDPKLVDCFKEEMTMVMKVGLLCTSVLPINRPSMRRVVEMLQEANPDHKAKATAKDGKLSPYYYEEPTIGIV

SEQ ID NO: 932 - protein, 635 aa, Pinus radiata
MGSWEQSTVPSIAWKLFIIVLLLILVEDHAVVGDNASDKKALLAFKAAVGKRLNWSQSTNPCTPWFGITCVGSSVTEVRLPGRSLFGSIPSGILGNLSELRVLSLRYNSLNGPVPSDLGKCTQLKKLYLQSNGFTGPIPSFFSTFPNLVIMNLAFNRFSGPIPSSLSNLQKLATLYLDNNSLNGSISALNPPNLQQLNVSNNQLSGSVPPTLQKFPASSFLGNSLCGSPLLSCVGGVAPSPNPSSGHKGKNKLGAWAIVGIVLGCLAFLVLLFLILFFCKRKKKRENPRVVEFAPGIKAPDDAPEDTIPKEDFPAPPVQEVEKNTSKRLVFFEGSQRTFDLEDLLRASAEVLGKGSVGTAYKAVLEFGLVVAVKRLKDVVIGQKEFVQQIEQVGKMQHENLVPLRAYYFSKDEKLLVYDYMTMGSLSSLLHGNRGAGRTPLDWETRSRIALGAARGIEYLHSRGREISHGNIKSSNILLTRDYNAGVSDFGLAQLVSSTPSANRIVGYRAPEVTDARKISQKADVFSFGVLLLEILTGKAPSHGANDDGVDLPRWVQSIVREEWTAEVFDIELLRHHNFEEDMVQLLQVAIDCVAQYPDQRPSMKEVVKRIEDLRRNIEDDDGPEDLSSSAEIPD

SEQ ID NO: 933 - protein, 996 aa, Pinus radiata; identical to SEQ ID NO: 889

SEQ ID NO: 934 - protein, 828 aa, Pinus radiata
MDLLLLLIMMLVMMGVAMPTHSQRFPFNGWSMMGKPSLFPSSIAGYHEKRDVEALLTFRKGITLDPYGWLSNWTANNSHNVCLWNGISCSPNTNRVVSISLRYGRLNGTLSPYIGNLSLLRHLDLSSNALSGRIPAEFGQLKALRILDLSSNTLTGSIPTCIGNRGLNGTLDVDLSWNAFSGRIPNELFNCTRLQRIDLSHNSLTGSIPTSIGNCALLQKLDTGFNYLSGSIPAELGRLVHLESLWLESNALSGSIPTSLANCTSLTDLVISSNNLSGPIPSEFSRLVSLKFLWFEDNSISGSIPTSLVNCTSLFSLKGSGNKLSGPIPSVMGLMKSISTIDLSNNSLTGHIPPTLFNCTQLYELYLSTNNLRSSISIPPSITDTDLVYLDLSNNQLIGSLPRNIGQLSSLQSLVLSNNNLTGSLSHNIGQLSDLQLLDLSNNNLTGSLPLSISHIEDLQELDLYNNNIFGTIPNTISLTSLQILDLSKNNLDGSIPELNGSCSQLSFFSVHTNKLFGTLPMFLANCIEIQYLDLRKNNLTGHLPHYLKSFSELLILNFGYNNFHGGIPEWVTNFTYLYVLDLSNNKFSGRMPLHFERVQGFVNSSKNDDFEEKEITVHMKGCEYTLPYISSENTILDLSNNNLVGQIPASIGTLRNMRLLNLSGNQLEGLIPASLSNISTLEQLDLSKNNLSGHIPEELSKLYSLAVLDVSSNSLCGPIPGGTQFSTFSATSFQRNKCLYGCPLDSCSEKENPLGEGDNNSSSAHMKMGWLEHLDEKMSLMALGIGFGIGIWGVVGVFIFCNRARHWVLGLPPNKPQLFYGMYQFPT

SEQ ID NO: 935 - protein, 433 aa, Eucalyptus grandis
MGRGLFLGRGLFLCLLVFCTSVLMELSTAQMPGFVSLDCGGSQSFTDEIGLEWTPDDHFTFGERTNVSLTNETRTQYTTLRYFPADDRKYCYTLNVTTRTRYLIRATFLYGDFDSNNVYPNFEISLGPTFWSTIVISDASTIEVRELIFLASDPTISVCLSNATTGNPFISTLELRQFNGSMYFTGFENQFYLSTSARINFGAESEEPVRYPDDPFDRIWESDSVKRANYLVDVASGTKKVSTQLPIDVNRDERPPQKVMQTAVVGTNGSLTYRLNLDGFPGNGWAYSYFAEIEDLAPEDTRKFRLVLPGAPDISKAVVNIMENAQGKYRLYEPGFENLTLPFVLSFRFGRTIDSSKGPLLNAMEINKYVKKIDGSPDGGVIASIISPYTSAAWAQEGGDPCLPVPWTWVHCSSDSPPLITAVYMSTSCDVLV

SEQ ID NO: 936 - protein, 516 aa, Eucalyptus grandis
SYKLYFCSKLSGQNLTGNIPSDITKLSGLVELRLDGNALTGSIPDLSSCVNLEIIHLENNQLTGELPSSLATLPKLKELYVQNNKLSGTVPSGLLNKKLNLNYTGNMNLHEGGKSGSQTKIIIGSSVGAAVLLVATIASCLFIQKGKRNSKHDDNVQILPTQRLVSSLSNAPTEAAHCFMLSEIEEATNRFERKIGSGGFGVVFYGRLIDGREIAVKVLTSDSYQGKREFSNEVTLLSRIHHRNLVQFLGYCQEDGKNMLVYEFMHNGTLKEHLYGPLPHEWNFNWIKRLEIAEDAARGIEYLHTGCVPAIIHRDLKSSNILVDNNLRAKVSDFGLSKSQVDGVSHVSSVVRGTVGYLDPEYYISQQLTDKSDVYSFGVILLELISGREAISNESFGVNCRNIVQWARLHIESGDIQGIIDPNLREDYDIQSMWKIAEKALMCVQPHGHMRPSISEVLKEIQDALLIEREALAAREGLSDLSRNSFHSSVNMDAFDIPGTENYVAIDESIAQPTAR

SEQ ID NO: 937 - protein, 416 aa, Eucalyptus grandis
MAHFLGKLRSLLSLIVSLSLFFFFALPFASPVASLSTVSITETANRTLVCALIKTPGQTVFLNCTSFPAGIQIPANIDASFTGIVGGDGFLCGLRGKYFSTPSSLVCWRYSANGTEYSYRRIYRGPPVTELDSGDAHVCGLANGTSRLKCWQWRRFNRTPAPSYWSSVAVGGDYACGLMGTGKVACVGDNVPVVNNKRNGTFIAVAAGSGHACAISVDNKLECWGAAENDPPEGVFVSVALGENRSCALKDNGRVVCWGQGNFSLPEHLGDTSFVAIEAKRRVFCGVLTSNYSLCCWGNEHFDSRPGSMVFDNVLPGPCRRSQCPCLLPGSGNLCGQGYAVCRPCVNPAPAKHPPLPGPAPPPPPTVQPQGFCMGKLVVFLVVECVGSASFAVGLRFLAVQILPGEGLPRPRFRPP

SEQ ID NO: 938 - protein, 432 aa, Eucalyptus grandis
IQLQRNILHCQGQHRHRHQPFSPRGFAWENWWYSWWWNAWDRLPLLSVFGFLLFRYCQGRVCRVHDSGRLEETPHPDQTTNPPPQPGPLEKRLSHLVSMDSHLEEFPLQVLARVTNGFAEEFKIGTGSFGSVYHATLDDGREVAIKRAEISTAASSPHFGGGGPSVKRQNEDIDRAFLNELESLSRLNHKNLVKLSGFCEDGDELILVYEYVHNGTLHDHLHKFPDSPLNSWVARLRVALDAARAIEYLHVYAIPPVIHRDIKSSNILLDKSWTAKVSDFGLSLMGPEDDESHLSLHAAGTLGYVDPEYYRLQILTSKSDVYSFGVVLLELLSGYRAIQNNENGVPRNVVDFVIPYILQDEIHRILDRKVLPPNPIEIEAVRYVGYLAADCVSLEGKDRPTITEIVYSLERALATCLARPKLSRSSTESSTA

SEQ ID NO: 939 - protein, 400 aa, Eucalyptus grandis
MPRLTSSPPHIHFIFYIPCLVFLCSLSHVAESQVQDQEQQVLLKLRQSWQDPSSLDHWVTSNSSSHCTWPEVTCQDGSITELKLANLNINYSIPPFICDLKNLNKLDLSYNNIPGEFPTVLYYCSELTYLDLSQNYFEGPIPSDIDRMANLQVLILAANSFSFNIPVSIARLPKLRILHLYQSEYNGTYPEEIFGLSNLEELSLGYNDKFAPSQLPQNFTALKKLRFFSMPQTNLFGRIPEKVSDMEALEHLDLGINPLTGEIPGSIFALRNLSRLYVYMTNVSGSIPLAVSAANLSLIDLSANNLTGNIPEVFGKLKNLYSLNLQSNHLSGRIPEDIARLPALSDVRLSNNNLSGKIPLDFGKFFPAHEIRSGLQQLDRYISRTAVPRWHAVRVGRYGQ

SEQ ID NO: 940 - protein, 697 aa, Eucalyptus grandis
IYSPIICLVESRKISLVFPLCLMSGCPTTIYRARSPWTLASFSPLTRFEVAYNNLTGTFPEQLCHGGTLFGLAAMDNNLNGELPESLGNCSSLSVARLNSNGFTGNVPGGLWMSRNLTALILSGNGLTGELPKELSPNLTRIEVSNNKFFGKIPSTVSSWRNLRIFDASNNLLSGTVPTELTELPSLTTLLLGQNELSGILPTDIISWKSLTTLDLSHNKISGPIPSKIGLLPVLTQLDLSDNQLSGLIPPEIGQLNVNRLNLSFNRLSGPIPAKLENAAYDASFLNNPRLCASNSFMRINVCNAQSHRSSKTNLTLIVILAIAAAMCVLLVVLFMIRASRKNRDWFDSTPKLTSFQSLNFTESNILSGLKEHNVIGSGGSGKVYRIIVNPSGDAVAVKRISNNQKLNEKLEKQFVAEVEILGNIKHRHIVKLLCCISCENSKLLVYEYMENSSLDRWLHKKKRSSPISGVANNMILDWPKRLQIALGAAKGLCYMHNDCSSPIIHRDVKSSNILLDSEFNAKIADFGLARMLAEPGEAVSMTAVAGSFGYLAPEYAHTTRVNEKIDVYSFGVVLLELTTGREANDGDEDMCLADWAWRHIQDDNPISDALDEEIKDDSNVDEISNVFKLGIFCTATLPSTRPTIKEVLQVLLKCSDPLYNVEKKSRHKFDVVPLLENSKHEETLRRDFHVLECNTY

SEQ ID NO: 941 - protein, 316 aa, Eucalyptus grandis
MKIVRHLLLVAVAWWLQQGGASTVAGHCTRRCGSVAIPYPFGLEPQCASTEHTKEFLLYCNKTEGIGGRLLLGNYTIRKISVSDSTMVISLPELYDCYNETGRQINRSYLSIDLSSYPPYRLSATRNALTVLGCDTYALTNVTAVVDKYDFSRGGCISYCNESVDLAKETTCSGIGCCQASIPKGLRKLHIRIGSFNYHENVLPFSPCGVAFVGDKESFNISSKRLPTFNDSGKSSDLVLDWMIGWDVNCTQAKSNPSSYACGNNTDCHDFADGLGYRCFCQHGYKGNPYLSRGCQECKKSGGDLPPQSYCSDSFT

SEQ ID NO: 942 - protein, 744 aa, Eucalyptus grandis
FDSVSHRQDLRPSLPLHFSDKGNGRHLIRLYFFPFVYREYNLSTAKFSISAQNFTLLEGFQLDKGSVVKEYSFNITTNQLVLTFTPNTDSFAFVNALEVISLPIELIPHSARIVEMPGDYQNLQSKALETVLRVNMGNQTVHPQKDTLWRLWVSDDTFLKHSTVSIVSNVKAVTYKNGNVTENIAPPSVYGTATKLDSVLDPNLNVNITWLFSVDAGFNYLVRFHFCDIVNSTLGSFLFNVYINSWFAYRSFDLSTLTSNVIGRPYYFDVITSSTSSSALSVSVGPSPEGSYPMAILNGLEIMKISNSQDSLETSDSENGSLKTNSRSKIILIAGLSGGICIVLVVVSALFFVCRRRRKLAAVGHSKEDNFVMTQTGDKNSNSLAVFSTSTFGYRYPFTAIEEATNNFSEDLIIGTGGFGKVYKGIFRDGTKVAVKRGQSKSQQGLTEFRTEIEMLSQFRHRHLVSLIGYCDERNEMIIIYEFMENGTLKSHLYCSDRPVLSWKQRLEICIGSAKGLHYLHTGSTRAIIHRDVKSANILLDENLMAKVADFGLSKTGPEIDQTHVSTAVKGSFGYLDPEYLTRQQLTEKSDVYSFGVVMLEILCGRAVIDPSLPREKVNLVEWAMKWRERGRIQETIDPHLVAQASEESLWKFVEIAEKCLAQCGLDRPQMGDVLWNLESALQVQLKEEKPSDKGELAPRADWIGYLDTHPSASTTQFSMGSLGDLASVSMSKLFAKMAKEDMR

SEQ ID NO: 943 - protein, 524 aa, Eucalyptus grandis
LIQWTDLLSRRLSGRGIKGMIPSELNNLVQLTELWLDGNSFSGKLPDMSGLTSLQIVHLENNQLTGPLPPYLGTLPNLIELNIENNSFTGEIPPQLLSAKIKFKYGNNIGLHGHSRKKMQFRWILGASIGVFAVLILLLLGSLLLLHNLRRRKSHQKSNDKGGSLRTSTKTSTAYSIVRDGHLREEGSHYIALSDLESATDRFSKKIGKGSFGSVYYGRMKDGKEVAVKIMAEISNDGHQQFVTEVALLSRIHHRNLVPLVGYCEEEHQRILVYEYMHNGTLRDHIHDSVKQKELDWLTRLSIAEDAAKGLDYLHTGCNPGIIHRDVKTSNILLDMHMRAKVSDFGLSRQAEEDLTHVSSVARGTVGYLDPEYYGNQQLTEKSDVYSFGVVLLELISGRKPVSPEEDYGSDWNIVHWARSLIRKGDVMSIVDPILIGSFKIESVWRVAEVALQCVEQHGVSRPRMQEIILAIQDATKIEKDAESRLKNSPSSSRAQSSRKTLLTSFLEIESPELSNGCIVPSAR

SEQ ID NO: 944 - protein, 370 aa, Pinus radiata
MAFASDIWRWRKLSVCLSSLVTFLYFFGLLSAVSDDGATLLAIKKSFRDSDNVLYNWIDSASSDHCSWRGVTCDNVTFAVVALNLSHLNLGGEISPVIGNLKSLESIDLKGNGLSGQIPDEIGDCSALKILDVSLNYLYGDIPFSISKLKQLEQLIVKNNQLMGPIPSTLSQIPNLKKMDFADNQLSGEIPRLIYWNEVLQYLGLRNNFLVGTLSPDMCQLTGLWFFDVRGNNLSGTIPENIGNCTSYAVLDLSYNQLTGEIPFNIGFLQVATLSLQGNKLTGKIPEVIGLMQALTVLDLSDNHLTGTIPSILGNLTYTDKLYLHSNNLTGSIPPELGNMTKLGYLQLNDNQLTGQIPPELGNLEQLFEL

SEQ ID NO: 945 - protein, 502 aa, Pinus radiata
CRDLSANQLSGPIPSELGQLQNLVSLILNNNSLSGEMPWQLTNCFSLTTLNLSYNNLSGNIPVTQNFTRFTPESFFGNPGLCGYWIGSLCGISARQPKASVSTTAIVCISLGSVILVCVITIALYLSNQHKPFTKGSSSKTGQGSPRLVILHMDMALYMYDDIMRMTENLNEKFIIGNGATSTVYRCDLKNCKPVAIKRLYTHYPQSLREFETELETVGSIKHRNLVSLRGYSLSPHGNLLFYDYMVNGSLWDILHGSSKKIKLDWNTRLRIALGAAQGLAYLHHDCNPRIIHRDVKTSNILLDDNFEAHLSDFGIAKCIPSAKTHASTYVMGTIGYIDPEYARTLRLNEKSDVYSYGIVLLELLTGRKPVDNDSNLHQLILSKADNNMVMETVDPEVVATCIDLETVRKIFQLALLCTKRQPSDRPTMPDVARVLQSLLPTSKQAPSSRVNQPAASNNYRRYLDEYTEGNHRDVRGSSTSSSTSDGQLFVRFGEVISQNIV

SEQ ID NO: 946 - DNA, 2423 bp, Eucalyptus grandis
acggagagagagatgggatgcaggaaaatgcagctctttagtcctcaccacctccctctttccgctcattgaaaagtttcaagaacttggtccctttccatttcttgaaagagtttcttgttctttcccgttttcttgaaacatgcgagtgcgcagaaccctcctggtcgcgctcgccattgtcgcctcgttcttgttccccgttacggggcaagaccttgcttcggacaggaatgcgcttctcgccctgagatcctcgctcgctggccgcacgctcctctgggacgcgagccagcaaagcccctgttcttgggcaggcgtccaatgccagtccggccgtgtcacgtctcttcgctttcccggagcttcgctctctggtcaaatccccgtcggcattctcggcaatctgactgggctgaagactctctcgctccggctcaacgcgcttgctggccaaatccctccagatctcgcttcttgcaccggcttgcgcaacctgtacttgcaaggtaatcggttctcaggcccgatccctgagtctctgctgggtctacgcgagctcgtgaggctcagccttgcctccaacactctctctggggaaatttctcggagtttcagcaacttgactaggctcaggactctgtccctcgagaacaattcgctctctgggtcggttcctgctgagctgagcctgctaaagctcgagcagttcaatgtttcaaataatttgcttaatgggtcaattcctgatggtttgaacaagtttagttcggcttcgtttctgggtaattcattatgtggaaaaccacttggtccatgtcctccggatgtccctattcctagtattggacctagcgtggatacggggggtgagagtggtgaaggcggcaaaaggaagaagctttctggctctgctgtcgccggcattgccatcggttgtgtgttcagtttcatattcattgtcatattggcgatattcttgtgccgcaagagaggtagcaagagaacgaggtcgattgacatggcagtgcttaagcaacaagagatggtgcttaagcaacaagagatggtgcttcggggcgaaaaggcatctggggatgccgatatttgcgaattcaatggcgaatactcggtggcggctgctgctgcggctgcgatgactgtaccaactggaaggaaagaagcaaatggcggtggagcaagaaagcttgttttctttgggaaaatggcgagggccttcgatttggaggacttgctgagggcatcagcggaagtcttggggaaagggacatttgggacttcttacaaggcggtcctgaagatgggaaacatggttgcggtgaagaggcttaaggatgtgaacattgcagtgggggaattcaaggaaaagattgaagctgtgggagcgatgaatcacgagaatttagtgcctcttcgggctttctattacagcaacgatgagaagcttcttgtctacgattacatgcccatgggaagcctatctgctctattacacggaaacaggggggcaggaagaactccattgaattgggaattgcgctccagcattgccctaggagttgcccgtggcatcgaataccttcattctcaaggacatcatgtatctcacggaaacattaagtcgtccaacgttctcctcaccaagtcccacaatgctcgcctctccgattttggcctggctcacattgtcggcccctcggtagtacccacccgtctcgccggctatcgtgcaccagaagtcacggaccctcgcagagtatcccagaaggctgacgtctatagcttcggtgtgttgctcttggagcttttaactgggaaagccccggccaattctgtcttaaatgaagaaggcatcgaccttccgagatgggttcagtccgtggttcgcgaggaatggagctccgaggttttcgatctcgagcttcttaggtaccagaacgcagaggaggagatggtcgagctcctgcagctggccatggattgtgcggctcagtatcctgaccagcgcccttcaatgccggacgtgaggaggcgaatcgaagagttgtctcggcgtagcttgcccgatcatggaccgcagcctgatcaggtcgatgatgtggaggtcacgtcttctcactgaattgctcaggtctcaccactgccgggacactgccggccgccatgatgtatggtcttaatgctcccggctagcgtgtcaatatactctacttaggttgtcagaagaagccgatctttaagcccgcactttcttgcgaaggaaatttactatctcccctactttacctcaggcctagtctactgttttttcggtgcttcccttgtggtacgtgtcatggatcttgtaattatgacttccgcttttgcttttgatgcatatcctttgcaaaaaaaaaaaaaaa

SEQ ID NO: 947 - DNA, 3361 bp, Eucalyptus grandis
cttctctccatctctcatctcaaaatcccgctcttccgctcctttagcaaatatagaaaatgcgccccttcttgctcctcctcctcctcctcctcctccacctccgccgcggcgccgccgcctccgccgcccccacccgcctgacggagccgctcgccctcctctccatcagggccgccgtcaccggcgacccccagtccgccctctcctcctggacctccgccgccgccgccaacggcagcagccactgctcgtggcagggcgtcacgtgcgacgcccgccggcgccacgtgaccgccctcgacctctcgtccctcgagctcgccggcgccctctccccggacgtcgcccacctccgcttcctcacctccctctccgtcgccgccaaccagctctccggccccataccgccgcagatctccgccctcgccgcgctgcgctacctcaacctctccaacaacgtcttcaacggcacgttcccgccccggctcggcctcctccggaacctccgcgtcctcgacctctacaacaacaacatgaccggagacctcccagtcgccgtcgccgagatgccccagctccgccatttgcacctcggggggaactacttcggcgggaggatcccgcccgagtatggccggtgggagttcatcgagtacctggccgtctccggcgacgagctaaccggcgccatcccgccggagatcgggaacctgacgacgctgcgagaactctatctcgggtactacaatagctacgacggaagcttgcccccggagattggtaacctgtctcaactcgtcaggctcgatgcggctagctgcggattgtccggcgagataccgcctgagattgccaagctgcagaatctcgacactctgtttcttcaagtgaatgggtttgcagggtctctgcctgctgagataggctacttgaatagcctcaagtctctggatttgtccaacaatatgttcgcgggagagattcccgagtccttctctcagctgaagaacctgaccctcttgcatctcttcaggaacaagctgaatggtgagagtcccgagttcattgctgatttgcccgagttgcaggttctgcagctgtgggagaacaatttcaccggcagtattcctcagggtttgggcaagaatgggcatctccagatcgttgatctctcgtcgaataaattgacgggtactcttcctcctgatttgtgttatggtaatcagcttcagattttgattgctcttagcaactacctgttgggccctattcctgagtctcttgggaaatgccggtccttggagaggatccgaatgggggggaactacctcaacgggtcgatcccgagagggctattcgggttgccggagctgaaccaagttgagtttcaggataatctccttgttggagagtttcctgtgagcgatgattcgatagctttgaagcttggtcagattactctctcgaacaacaaacttggtgggtctttgccaccgactattggcaacttctcaggggtccaaaagctcctcctggatggcaataacttctcgggacaaatcccacctgaaatagggcgtttgcagcagcttgccaagattgatttcagcagcaacaggtactccggtccaattccggcccaaatcagccaatgcaagctgttaacctttgttgacctcagtgggaatgagctctccggtgagatcccgaacgaaatcaccggtatgaggatattgaactacttgaatttgtcgagtaataacctatccggcagcattcccccgtctatttccaccatgcagagcttaacttccgttgatttctcatacaacaatctgtctggtctagttccgggtaccggccagttcagttacttcaactacacttcgtttctgggtaaccctgaactctgtggaccatacttaggcccttgcaaagatggagaaatgactggaatccatcaagcgcatgtcaaagggccactttctgcttcagtgaagctcctccttgtcattgggttgctcgtgtgctctatcatcttcgcgatcgtggcaataatcaaggccagatccctcaagaaagccagcgatgccagggcatggaagttcagcgccttccagaggctggacttctcttgcgaggatgtcctggatagcttgaaggaggacaacatcatcgggaaaggcggcgcggggatcgtgtacaaaggcagcatgccgaatggcgatcatgtcgccgtgaaaaggctgcccgtgatgggaagagggtcttcccacgatcacggattcaacgctgaaatacaaactctgggaaaaatcaggcacaggcacatcgtaaggctactgggattttgctcaaaccacgaaaccaatcttctggtctatgagtacatgcctaatgggagcttgggcgaggttcttcatggcaagaaaggaggccacttgatctggagcgtgaggtataagattgccctggaagctgcgaaagggctctgctatcttcaccacgactgttcgcctctgattgtgcacagggatgtgaagtccaacaacatcctgctcgactctgattttgaagcccacgtcgccgacttcggcctcgccaagttccttcaagattcgggcgcatccgagtgcatgtcggccattgctgggtcctatggatacattgcgccagaatatgcatacactttgaaggtggatgagaagagcgatgtgtatagctttggcgtggtcctgcttgaactagtcaccggaagaaaaccagttggggaatttggggacggggtcgacattgtccaatgggtccgggaaatgaccaactcgaacaaggaggaggtccagttaatcctcgaccccaggctgaacaccgtcccactccatgaggccatgcacttgttttatgttgccatgctctgcgtcgaggaacaggcggtcgagcgcccgaccatgcgggaggtggtccagatcctgactgagttcccgaagccatgcaatgtgaaacaggacgaacccttaacgagcccactggagtctcccacgaaagaagcgagagatggtcgtagatccccaccgccgccccagtcgccaccgccgccgcccgatcttttaagcatttagtagactttcttgtttgtgtgggagttcatgcttatccaatttttctttaactatggtctcgaaggggggtgggggtttaatgtgttgaattaaaagtccttttgtcttgatgtacagggggaggggttatcttgtcatgaatctttgtcctttatcttgaagtgtacttatggcctgtgatctctggtttctgcttcatgaatcatcaagtaagggcttttgtgaaaaaaaaaaaaaaa

SEQ ID NO: 948 - DNA, 1843 bp, Eucalyptus grandis
acatatatttgtgaaagtccatctggctgaccaagtaaagggtgcgactaatgcacacgctaaaacttgcctaaatggacgaccagaggaagatatactgatttctgatgggtcacacttggaaacattgagtggatgcgaagtagccgatgagaggaacagttgggatacctttaaccttttggtagctgaagaccagttcaattccgttgattccaacatgactagtaacgaagcttctgaaaatgtcacggtaatggtcagtgttgaagataccggcatcggcattccattgcgggcccaggatcgtgtatttatgcccttcatgcaggcagatagctcaacttctagaacttatggtggaactgggattggcttgagtattagcaagtgtctggttgagctgatgggtggacacataaacttcataagccggcctcagattgggagcacattctcctttacggctgtgtttggaagatgcaaaaggcttgtgtttgctaatgtgaaaaggacttttgaagatcttccttctggttttaaaggattgaaagcaatagtggttgatggtaagccagtcagagctgccgtaactagataccatttgaatagacttggcattaacgttgaagttgcaagtagcatcaatgctataacagctacgggcgggaaaaatggttctctgactgctggatatcggcacccagacataattctagttgagaaagatatgtggatgtccagcattgacagctggataagtttaacggtggcagactggaaacagaatggcaatttaattcagcttccgaaaatcctcctcgcaagcaaaatcagtgcttctgaactagagaaggcgaaagcttctggttttgccgatactgtcattatgaaaccagtgagagcaagcatgcttgctgcatgtctgcaacaggttctgggcatcggaaggaagaagcaattgcagaaggatatgaacatgcgaaatggatctagcgccctgcggagccttctctatggcaagaagatattggtggtcgatgacaacaaggttaatcgaagagttgcagcaggcgcactcaagaaatttggggccaatgtagagtgtgcagagagtggaaaagctgcattagagttgcttcaactgccacatgactttgatgcttgtttcatggatatccaaatgcctgaaatggatggatttgaggcaacacgacagattaggctgatggagagccaggtgaacgagcaaatgaaaagtgaatctgcagttcaaatcgtaaaagggggtgagtggcacatgccaatattggcaatgacggcagacgtgattcacgcgacttatgacgaatgccttaaatgcgggatggacgggtacgtctcaaagccctttgacgaagagaatctttaccaggcggttgccaaattctttaggaccaaacccgtctaggacttgaaaacttccaagtgtctggtgaattcatggatgtcacaactcagatgttgcagtgaaaaaaagtgaccagcgattttgtattctgctggttggtttttcatgtcgataatggccccactcaaaaatgccggcactggtaaattgttcttacctgactcaaatcattattttaactagagtagaatgaatcggagtatttgtatactaccatagaacatccagccctgcttgtctgtatagatcttaaaggaggggcgaggagtccaaaaggtgtatattttcatcgtcgtaaaaaaaaaaaaaattttttctcagaaatctctgaaccacttaatacaatctggaaatgctcttttcaagctttccttcattaaaaaaaaaaaaaaa

SEQ ID NO: 949 - DNA, 3768 bp, Eucalyptus grandis
ctaatacgactcactatagggcaagcagtggtaacaacgcagagtacgcgggggttgtggatgagtttgctccatgtactctgtttcggtctgaaggtggggcatctactatgggtgctgtgctgctgggtggtgtccttgatttccaagaattggtgggtttttggtggtgagatgaccaaggccggttttcttggcgatgggggcaaaatgtcactgaattggttggagaaggtgttggggaatgtttacaagatccaccccagccacaacagccagcaagctgggtcgaagaaattcaggaagacttggtggaggaaggtcttgtggacgtggatcatcggctggttcatcatctctgcgtgtatcttctggtacatgagctcgcaggccgcggagaagaggagagagaccctcgggagcatgtgcgatgagagagctagaatgttgcaggaccagtttaatgtcagcatgaaccatgtccaagccatgtccattctgatctccactttccaccatggcaagcagccttccgctattgaccagacgaccttcgagaggtacacagaaagaactgcttttgagaggcctctgacaagtttcattgcgtatgcggtaagagtgcttcattgtgacagagaagagtttgagaaggcacaaggttggaagattaagaggatggataccgtggaaaaaaccccagttcacaaggataactctgaacttgaagaatcggaaccgtccccagtacaagaagaatatgcgccagtcatctttgcacaagataccattggccatgtcgtttctcttgatatgctgtcaggaaaggaagaccgtgaaaatgttttacgtgcaagagcttctggaaaaggggtcctgactgctccatttaggttgattaaaacaaacagtcttggagttatattgacctttgctgtatacaataaggatctaccaccaaatgccactcctgatgagaggattgaggcaactgacgggtaccttggtggggccttccatattgaatcactagtagagaagttgcttcaacagctcgcaagcaagcagaacattgttgtgaatgtatatgacaccagcaattggtcacatccaatcagcatgtatggttcagatgtatcggaagattatctagagcatgtcagcactctcaattttggggatccgttcaggaaacatgagatgcgctgcagattcaaacaaaaatcaccatggccatggcttgcaataacgacatcatttggcattcttgtgattgccttacttgttgggtatattttccaagcaacagtgaatcgaattgccaaagttgaagatgactaccataagatgatggaacttaagaagcgagcagaggcagctgatgtggcaaagtcacagtttcttgccactgtttcgcatgagatcagaacccccatgaatggagttctaggaatgttgcatatgttgatggacacagatcttgatgaaactcaacaagattatgttagaactgcacaggaaagtggaaaagctttggtttcacttataaatgaggtcttggaccaagcgaaaattgaatctggtaagattgagattgaggctgtgcagtttgatctaagggccatattggatgatgtcttgtccctcttctcggggaaatctcaagaaaaacgagtggagctagcagtttacatttctgaaaatgttccggagaagttgattggtgatccagggagatttcggcagatcatcacaaatcttatggggaactcaattaaattcacagagaaaggacatatcttggtcacagtccatcttgttgatgaggtgatgaactcaactgatgctgagatggaatcagcaacaaggagtacgttgagcggcttcccagtaccagacagacgactcagctgggcaaaatttaggacattcagccaggaaggccctgcgtctccggtgccgtcatccttctctaatccaatcaatctcattatttcagtggaggatacagggataggtattcctccagaggcgcaaccccgcgttttcactcgtttcatgcaagtgggcccatcaatttctcgaacacatgggggcacaggtattgggctaagcataagcaaatgtctggttggcctcatgaatggggagattggatttgtaagcataccccaggtgggatccacctttacctttactgcagttttcgatgatgcctgttctacctcaaaagagtgcaagggccagcaagtgaaaggacaaggtgactctggcacctcagaatttcatggtatgaaagcattggtagttgacacaagacctgtccgtgccaatgtatcaaagtatcatatccagaggcttggtattcacgttgaggtagttgcagacttgaaccagtgcctccacaccatacaaagtgggaattgcagaatagatatggtgctcttggaatgggaaatttgggacaaggactctggtttgtcggcaatctttctggataaattgagggacatgaagccacgggtgtctccacggttgtttcttctatctaattctatcagctctagtaggatgagtggtgcgactacagatgctactggtccattcgtgatcatgaagcctctaagggctagtatgctggtggcgtcttttcagcgagtcatgggagtcgtaaatcgaataagttgctccaatggggagtctccgagtctgtttctccgcaaccttctccgtggcagaaaaatcctagtcgtggatgacaacaaagtaaacctcagagtggccgagggagctttgaagaaatatggagctgatgtggtttgtacagacagtggggaaaaagcaattgctttgctcagaccaccgcatgattttgatgcctgcttcatggatatccagatgccaggaatggatggatttgaagctacaaaaagaattcgacagatggaacaaactccgagcaaggaattcctaccgggacagtcatcctcagagccacgtgaaaatatctcgaatttccacctaccgatcttggccatgactgcagatgtgattcacgctactcatgaagaatgcacaaagtatggaatggatggatatgtttcaaagccatttgaagcggaacaactttttagagaagtttcgcgctttttcccagtcatcattgaaccgaaacttgtagagaggccaccatagatggctaattgttttggtgagcagaagtcttggttgtttaggcaatttggcagccttaccggtgaactttggaattctttaacaagagtgtgtcttgtcacgggagcatatacataaagaagctaaggtcacccgctggagttgaattttcattgatttccctacgagtggcgtattggttcaaaaccacttcaattattttgtgtacagctgatctaaaccgtttgcaagatgacggttggtaatcaggcgatctgaagttcgccaattgaactctggatcgatggctgcttggaaatggtgcaggaatctctctgacataggtgtatatctgtagactagaccctcacagtgtgtacatgcatttagctttagagactgtagccaggaggtttggttagactgcattccctttagagacagagcattccatgtatattactcgaataaagaacatcagtattcgcattcaagtttgccccagtcaattttgtttgaagcatgtaaagggtcgaggccatgactgatgtatagtacaacgactctcttcgtcgccaaaaaaaaaaaaaaaaa

SEQ ID NO: 950 - DNA, 3878 bp, Eucalyptus grandis
ggcacgaggacgatcctcgccaccatattcttcactatcctcttcacgcagattcttcttctttcatcccttttactttaattttcccttttacgaagcgcagggtcggggagggaaaaagggaagagctttttcggcctcttacagtgggttccttttgcagttacttctccgcacagcatattagtttcgagcgggtggtcggttccttccaacgagagtcaaacctcaaagaactctgcttgctctcatatcttgtctctgggcttcaggagctcccttttgatctgctctcttttgggtgctgagttgggaggtttgagtgggcttctttgcctcttcgattgccgtacgacgatcaccaagggggctcatggatgccaagactggcctgcttggaggggatggcaagatttcgctgaactggcgtgacaaagtcttggggaaaattgtcaagattcagcatcagtatgaccacttgtttgggtccaagaaaattagcaacgcattgtggaggaagctgttgtacacatgggtgttttgtgcgaccatgttttctctgtggattttctcatacatgagctcgcaagctattgagaagaggaaagagacactagctagtatgtgcgacgagagggctcagatgttgcaggaccagttcaacgtgagcatgaaccatgttcaggctatgtcgattttgatctcaacctttcaccatggcaagagcccctctgctattgaccagacaacttttgctgaatataccaaaagaactgcatttgagaggcctctcactagtggtgtggcatatgcagtgagagtgctccattcagagagggcagagttcgagaaacagcaaggctggcctatccagagaatggacacccttgagcaaaatctggttcataaggatgactttgaccctgaagtgttggagccctctccaattcaggaagaatacgcccccgtcattttcgctcaagatactgtctcccacgtagtttccattgatttactctcaggaaaggaggatcgtgaaaatgtactgcgtgcaagagcttcaggaaaaggggtgcttaccgctcctttcaggctgattaaaacaaaccgcctgggggtcatattgacctttgctgtctataaaactgatcttccttcaaatgcaactccggatgagagaatccaggcaactgctgggtacattggtggtatctttcatattcaatcattggtggagaaattgctgcaacagctggctagcaagcagaacattgtgctgaacgtattggacaccaccaatcagtcacatccgatcagtatgtatggttcagatgaagcggatgatgctttggagtatgtcagtacccttaattttggcgatccatttaggaagcatgaaatgcgatgcagattcaagcagaaacctccatggccttggcttgcgataacaacatcgtatggatttcttgtgattgcgatgctcactgggcatatatgttatgcaacagtaaataggattgccaaagtcgaagatgactaccagaaaatgatggagctcaagaagcaggctgaggcagctgacatagcaaagtcacagttccttgccactgtttcccacgaaattagaactccaatgaatggtgttttaggaatgttgcatatgttgatgcacacggatctagatgtaactcaacaggattatgttagaactgcccaggccagtggaaaagctctggtctcacttatcaatgaggttttggaccaagcaaagattgaatctggtaaactggaacttgaggcggtacaatttgatctgcgggccatactcgatgatgtattgtccctcttttctgggaagtcccaggaaaaaggagtggagttggccgttttcatttctgatcaagttcctgagaagttaattggtgaccctggaagatttcgacaaatcataaccaaccttatgggaaactcgattaaattcacagagaaaggccatatctttgtcacagtgcatcttgctcaagaggtcatggactcattagatgttgagactgagtcatcgtcgaagaataccttgagtggcttccaagttgctgagagacgtctcagctgggcgaaattcaagacctttagccaacatgaacgtgtttgttcttacccttcctctacctacgacctcatcaatctaattgtatcagttgaggatacaggagttgggatcccatttgaggcccaatgtcgtgtttttactcccttcatgcaagttggtccttccatatcccgtacacatggagggactggcatagggctaagcataagcaagtgtttggttgagctcatgaacggagaggttggatttgtgagcatacccaatgtaggatccacatttaccttcacggctgtcttcaacaatggccattccaatttgaatgagtacacgtgccagcaaatgaacaatcaatccaattctgcaaactcggagtttgagggcatgagtgcactagtggtggatcccagatccgtccgagccaaagtatccaagtatcatgtccagaggcttggaatccaagttgagattgtctcagacttgaatcaagttttgtcgtcattaaaaagcaggaaacccagaattgacatggtgcttattgaagaggaggtctggaacaatgattcagatttgtccattctttttgttgatcagttaaggcatatagaccaaaaggttactccaagactcttccttttagcaaaatccattagttcaacccggagtgacaatgtgacttgtgatactcatagtcctgctgtcatcatgaaacctctaagggctagtatggtggccgcttgtctacagcgaaccatgggtaacatggggaacaagggaaattaccgcaacggcgaagtctccaggttatctctgcagcatcttctcctaggaagaaaaattctaattgtagatgacaataaggtgaatcttaaagtggctgcgggtgcattgaaaagatatggggctgaactggtctgtgtggaaagtgggaaagaggcgattagtttgcttacaccaccacacagcttctatgcttgcttcatggatatccagatgccgggaatggatgggtttgaagctacaaaaacaatccgagacgtggaaaaaagtgtcaaccggaaaatccaacttggggaagtatctgcagaagcacatggaaacgtcttgaattggcatgtgcccatcttggccatgacggcggacgtgattcatgcgactcaagaagagtgcatgaagtgtggaatggatggatatgtttcgaagccttttgaagcagaacaactttatcgggaagtttcacgattttcctattcagctgagagtcggaaactgtaaaggtgactccattgcaggtcgctgaattcataatggatcgtcattcttctcacttctcctcaatgaagtcaaagttcttcaccaaaacattttcaggtattacgtggaagagtgtgtaaatagagcaatgccttattgccggcaaattgatttttgacagattgtccatagatagcaaccgcttgttgttttttccttacacgcttcatctcatcacgtgtgacctccatcagcagccgagcaaatagaagttcattagagggattcagattcggaacaaggataagtcccgggaaatcgtgtggattggttgtatcatagcagcaatggcggcgttgtgtcgtctttcttatacatatgtagcaaactcaccattcacaatgaccttgttcttcttatcttaggacagctactgtctgtagagtctgaactagagcgttggattcagatgtaagaatgaaagttgtagatcttagcaaaaaaaaaaaaaaaaaaa

SEQ ID NO: 951 - DNA, 3545 bp, Eucalyptus grandis
gcacgagcaaccgtcagctatagatcagaaaacttttggagaatacacagaaagaacagcttttgagagaccacttactagtggtgttgcgtatgctttaaaagtacctcactcagagagggagcaatttgagaagcgacatgactggacaataaagaaaatggaaactgccgatcagacacttgtgccggactatatgctagataggttggacccggcacctattcaagatgagtatgcacctgtcgtattttctcaagaaactgtctctcacatagtctccattgacatgatgtccggaaaggaagatcgggagaatatactgcgggctagggcatctgggaaaggagtactgacttctcccttcaagcttctgaagtcaaatcaccttggtgttgtactaacttttgctgtatatgatagagaactgcctgctgatgctacagctgagcaacgtattgaagcaacagtggggtatttgggtgcatcttatgatgtcccttccctagttgagaagcttctgcatcagttggccagcaagcagacgattgtcgtaaatgtctatgacacaaccaatggatctgcaccaatcaatatgtatggtgatgacgtcattgacactgggctggttcgcgttagtaatgttgattttggggatccacttaggaggcatgagatgcactgcaggttcaagcagagacctcctttgccgtggactgcaataaattcatcagttggactgctggtcatcacgttgcttgtcggccatatttttcatgcagctataaatcgaattgctaaggtggaggaggactatcgacagatgatggagctgaaaagtcgtgctgaggctgcagatgtggcaaaatctcagtttcttgcgactgtttcccacgagattagaactcctatgaatggtgttttagccatgctgcaaatgcttatggatacaaatctcaatgcaaatcaactggattatgcccaaactgctcatgcatgtggaaaagatttgatatcactgatcaatgaggttcttgatcaggccaagattgaatctggacgtctcgagctagaaaaagtgccttttgatcttcgtttggctctggataatgtgctatcacttatttcgggcagatctaatgaaaaaggaattgagttggctgtctatgtctctgatcgggtaccggaagctgttattggtgatcctggtcgattccggcagataattacaaatcttgttgggaactcaatcaagtttacacatgaagggcatatatttgtctcagttcatctgctagaagaaggatgcagtcagcatgattttagagatgtggagaagagactaagttcaaacttagttgaagatacatcggacaaaacttttaatacattgagtgggtttcaagtggttgacagaaggaaaagctgggagcgctttaagaagttaaatcggtccgatcaaattgatgtgaatgaatcagttgaagtacttgttactgttgaggatacaggtgttggaattgccagagaggcacaaagccgcatattcacaccttttgtgcaggctgatagctccacatcacgtacatatggtggcactggaattggcttgagtattagcaaatgtctagtggatcttatgcacggggagatcgggtttgtaagtgaaccgggcactggaagtacattttcctttactgtaccctttgcaaaatgtgaaatgaactgtcttgaagtgaaggggcaaaattacgattcaatcatatcagagttcagaggattgagagccttggtgatagataaaagacacatccgagctgaggtcgcaagatatcatcttgagagactaagaatatcagtggacgtcgcttgcagtttgaagtcagcctgtacttacctttccaactcttctagcccaagggaactatcggattttgacatggttctcatcgacaaagatgtttgggacaggcaaacaggtttagaactcaatatttcactttggaaacacaggcaaaatggcagcaatggagtgtcaatacgtcccaagatttttcttctggctacatccattagtccaattgagcacagcgagctcaaattagccaacctggtagataatgtgctggcaaagcctctcagattgagtgtcttgatatcctttctccaggaagccctcggtaatggtaagaagaggctatctgataggagaaaagtatcaactcttggcagtttgctgaaaggaagaagaatcttggttgtggatgacaacttggtaaacagaagagtagcagagggtgctttaaagaaatatggtgccattgttacctgtgttgggagcggtaaggatgctgtggccaagcttcagccgccccatgacttcgctgcttgcttcatggatttgcaaatgccagagatggacgggtttgaggcaacacgacaaattcgtcacctcgagagtgaggttaatagtaagattgcatctggggaagtatcttccgatgcatttcagaatgtggtacattggcatactcctatcttagccatgacagctgacgtaattcaggctacaaatgaagaatgcctcaaatgtggaatggatgattatgtctcaaagccttttgaagaagagcagctttattcagcagtagcacggttctttgagtctggctgagagataacgatatgatggcagcacatctactgtcaaaagctccacgtcagtggctgatcacttttcacaacttcgctggggcttgcccttttggggcgggggacatcaaatggttgtcatgacgtgccttgtgcattgtacagctatggtctttcctggtggcattcttggagttccaggagctatgagtttgctgccttaactgatggactcaaatatttgattctgggcagcagtatactggcgtcatggcgcatcctgatctgtcaacattgatataggatttgttcttttctcagaatagattcaacaaaagggcgtggcttggggattgttcagagtcccagctagcctggttgcagagtggaactcagctctgcagatcctactaccgtgctgcagctaaaagtgagcttcgaggaggatgaatgaccattattttttacccttggaggtgtgcctctctgagatgcatcgtggacccccaagttgttgagattgatttctcgggcatgtcagcccttctgtcagatgtagaagggagttgagttcctcattcttttcccctcgccggtggacgtctctccgatgcttaataaaggattgtattcttttggacactgaagaataaaattgtcaagcgtattttctaccgtggtggaagaatatagttagtttttgtttcctattatagagtgttgatccctgttccagcaaaaaatgacccagctgaaagggtctaatctttattaacattatcacaaacgcattctcaatctcgtgtggatatcataatgtggagattactgtggttctattatccccacagagaatgatatgtgactttggatagaaaaaaaaaaaaaaaaaa

SEQ ID NO: 952 - DNA, 1081 bp, Eucalyptus grandis
gcagaacgagcgggtcattgcaagattgatgataagagagggcggcaatggcatataatgcatgtgacccccgaaagcgagcctcgcgagccttcacctgttcaggaagagtatgtacgctacgaatttggtgaagatgacaatgcttatatggggcctcttctgagttcacttggcatgatgacaggagaggaagatcgacatcatgtattgaaggcaagagctgttgaaaaagctgtcttatcagcccccttcaggctgttttcgtcaaatcggaccggagtgattttgatatatcctgtttacaaatccaaattctcaccaagcgtgagtttggaagagcgcatcagagccactgcaggatatattggtggactctttgaattcgagtcccttgtggagagcatactctggcaacttggaaatcagacggttttggtcaaagtatatgacatcacaaactgtcgtccctcattgatgtatggtcccaattatgtcaaatttgaccggaccatggcgcacatgagcaagcttgaactcggagatcccttcaggaagtacctgatgatatgtaggtatcaagatgaggcctctaaatcttggctgccagccattgccgtagtcttgattgtcaccatcggtttgttagcaccttgcgtgctttatgctgcagctattcacgtcgcgaaactcagacaagcctcactccaaatacaaggattggaagttcaactgcaagatgcgaacatggccaattcccagagactcttgccatgcttctcgagactgaactgagcttgggtacaaaggagctacactcggattgctcatgcttgtggaaggaggcaggattgcattagtagacagcgcactcgaatcaccaaattcggcggtcataagtcgcaccacctagaatgttgcttggacagtttgagattgagtgctctgattcagctttcaagtcatgaaaattctagggaaaggtattacttgcagatcagacagaaaatttctggtgtgattgactattgacatggcttatgtaattttctgcatttgccgcacaaaaaaaataaaaaaa

SEQ ID NO: 953 - protein, 653 aa, Eucalyptus grandis
VASFLFPVTGQDLASDRNALLALRSSLAGRTLLWDASQQSPCSWAGVQCQSGRVTSLRFPGASLSGQIPVGILGNLTGLKTLSLRLNALAGQIPPDLASCTGLRNLYLQGNRFSGPIPESLLGLRELVRLSLASNTLSGEISRSFSNLTRLRTLSLENNSLSGSVPAELSLLKLEQFNVSNNLLNGSIPDGLNKFSSASFLGNSLCGKPLGPCPPDVPIPSIGPSVDTGGESGEGGKRKKLSGSAVAGIAIGCVFSFIFIVILAIFLCRKRGSKRTRSIDMAVLKQQEMVLKQQEMVLRGEKASGDADICEFNGEYSVAAAAAAAMTVPTGRKEANGGGARKLVFFGKMARAFDLEDLLRASAEVLGKGTFGTSYKAVLKMGNMVAVKRLKDVNIAVGEFKEKIEAVGAMNHENLVPLRAFYYSNDEKLLVYDYMPMGSLSALLHGNRGAGRTPLNWELRSSIALGVARGIEYLHSQGHHVSHGNIKSSNVLLTKSHNARLSDFGLAHIVGPSVVPTRLAGYRAPEVTDPRRVSQKADVYSFGVLLLELLTGKAPANSVLNEEGIDLPRWVQSVVREEWSSEVFDLELLRYQNAEEEMVELLQLAMDCAAQYPDQRPSMPDVRRRIEELSRRSLPDHGPQPDQVDDVEVTSSH

SEQ ID NO: 954 - protein, 1021 aa, Eucalyptus grandis
MMRPFLLLLLLLLLHLRRGAAASAAPTRLTEPLALLSIRAAVTGDPQSALSSWTSAAAANGSSHCSWQGVTCDARRRHVTALDLSSLELAGALSPDVAHLRFLTSLSVAANQLSGPIPPQISALAALRYLNLSNNVFNGTFPPRLGLLRNLRVLDLYNNNMTGDLPVAVAEMPQLRHLHLGGNYFGGRIPPEYGRWEFIEYLAVSGDELTGAIPPEIGNLTTLRELYLGYYNSYDGSLPPEIGNLSQLVRLDAASCGLSGEIPPEIAKLQNLDTLFLQVNGFAGSLPAEIGYLNSLKSLDLSNNMFAGEIPESFSQLKNLTLLHLFRNKLNGESPEFIADLPELQVLQLWENNFTGSIPQGLGKNGHLQIVDLSSNKLTGTLPPDLCYGNQLQILIALSNYLLGPIPESLGKCRSLERIRMGGNYLNGSIPRGLFGLPELNQVEFQDNLLVGEFPVSDDSIALKLGQITLSNNKLGGSLPPTIGNFSGVQKLLLDGNNFSGQIPPEIGRLQQLAKIDFSSNRYSGPIPAQISQCKLLTFVDLSGNELSGEIPNEITGMRILNYLNLSSNNLSGSIPPSISTMQSLTSVDFSYNNLSGLVPGTGQFSYFNYTSFLGNPELCGPYLGPCKDGEMTGIHQAHVKGPLSASVKLLLVIGLLVCSIIFAIVAIIKARSLKKASDARAWKFSAFQRLDFSCEDVLDSLKEDNIIGKGGAGIVYKGSMPNGDHVAVKRLPVMGRGSSHDHGFNAEIQTLGKIRHRHIVRLLGFCSNHETNLLVYEYMPNGSLGEVLHGKKGGHLIWSVRYKIALEAAKGLCYLHHDCSPLIVHRDVKSNNILLDSDFEAHVADFGLAKFLQDSGASECMSAIAGSYGYIAPEYAYTLKVDEKSDVYSFGVVLLELVTGRKPVGEFGDGVDIVQWVRKMTNSNKEEVQLILDPRLNTVPLHEAMHLFYVAMLCVEEQAVERPTMREVVQILTEFPKPCNVKQDEPLTSPLESPTKEARDGRRSPPPPQSPPPPPDLLSI

SEQ ID NO: 955 - protein, 482 aa, Eucalyptus grandis
HIFVKVHLADQVKGATNAHAKTCLNGRPEEDILISDGSHLETLSGCEVADERNSWDTFNLLVAEDQFNSVDSNMTSNEASENVTVMVSVEDTGIGIPLRAQDRVFMPFMQADSSTSRTYGGTGIGLSISKCLVELMGGHINFISRPQIGSTFSFTAVFGRCKRLVFANVKRTFEDLPSGFKGLKAIVVDGKPVRAAVTRYHLNRLGINVEVASSINAITATGGKNGSLTAGYRHPDIILVEKDMWMSSIDSWISLTVADWKQNGNLIQLPKILLASKISASELEKAKASGFADTVIMKPVRASMLAACLQQVLGIGRKKQLQKDMNMRNGSSALRSLLYGKKILVVDDNKVNRRVAAGALKKFGANVECAESGKAALELLQLPHDFDACFMDIQMPEMDGFEATRQIRLMESQVNEQMKSESAVQIVKGGEWHMPILAMTADVIHATYDECLKCGMDGYVSKPFDEENLYQAVAKFFRTKPV

SEQ ID NO: 956 - protein, 1044 aa, Eucalyptus grandis
MSLLHVLCFGLKVGHLLWVLCCWVVSLISKNWWVFGGEMTKAGFLGDGGKMSLNWLEKVLGNVYKIHPSHNSQQAGSKKFRKTWWRKVLWTWIIGWFIISACIFWYMSSQAAEKRRETLGSMCDERARMLQDQFNVSMNHVQAMSILISTFHHGKQPSAIDQTTFERYTERTAFERPLTSFIAYAVRVLHCDREEFEKAQGWKIKRMDTVEKTPVHKDNSELEESEPSPVQEEYAPVIFAQDTIGHVVSLDMLSGKEDRENVLRARASGKGVLTAPFRLIKTNSLGVILTFAVYNKDLPPNATPDERIEATDGYLGGAFHIESLVEKLLQQLASKQNIVVNVYDTSNWSHPISMYGSDVSEDYLEHVSTLNFGDPFRKHEMRCRFKQKSPWPWLAITTSFGILVIALLVGYIFQATVNRIAKVEDDYHKMMELKKRAEAADVAKSQFLATVSHEIRTPMNGVLGMLHMLMDTDLDETQQDYVRTAQESGKALVSLINEVLDQAKIESGKIEIEAVQFDLRAILDDVLSLFSGKSQEKRVELAVYISENVPEKLIGDPGRFRQIITNLMGNSIKFTEKGHILVTVHLVDEVMNSTDAEMESATRSTLSGFPVPDRRLSWAKFRTFSQEGPASPVPSSFSNPINLIISVEDTGIGIPPEAQPRVFTRFMQVGPSISRTHGGTGIGLSISKCLVGLMNGEIGFVSIPQVGSTFTFTAVFDDACSTSKECKGQQVKGQGDSGTSEFHGMKALVVDTRPVRANVSKYHIQRLGIHVEVVADLNQCLHTIQSGNCRIDMVLLEWEIWDKDSGLSAIFLDKLRDMKPRVSPRLFLLSNSISSSRMSGATTDATGPFVIMKPLRASMLVASFQRVMGVVNRISCSNGESPSLFLRNLLRGRKILVVDDNKVNLRVAEGALKKYGADVVCTDSGEKAIALLRPPHDFDACFMDIQMPGMDGFEATKRIRQMEQTPSKEFLPGQSSSEPRENISNFHLPILAMTADVIHATHEECTKYGMDGYVSKPFEAEQLFREVSRFFPVIIEPKLVERPP

SEQ ID NO: 957 - protein, 1002 aa, Eucalyptus grandis
MDAKTGLLGGDGKISLNWRDKVLGKIVKIQHQYDHLFGSKKISNALWRKLLYTWVFCATMFSLWIFSYMSSQAIEKRKETLASMCDERAQMLQDQFNVSMNHVQAMSILISTFHHGKSPSAIDQTTFAEYTKRTAFERPLTSGVAYAVRVLHSERAEFEKQQGWPIQRMDTLEQNLVHKDDFDPEVLEPSPIQEEYAPVIFAQDTVSHVVSIDLLSGKEDRENVLRARASGKGVLTAPFRLIKTNRLGVILTFAVYKTDLPSNATPDERIQATAGYIGGIFHIQSLVEKLLQQLASKQNIVLNVLDTTNQSHPISMYGSDEADDALEYVSTLNFGDPFRKHEMRCRFKQKPPWPWLAITTSYGFLVIAMLTGHICYATVNRIAKVEDDYQKMMELKKQAEAADIAKSQFLATVSHEIRTPMNGVLGMLHMLMHTDLDVTQQDYVRTAQASGKALVSLINEVLDQAKIESGKLELEAVQFDLRAILDDVLSLFSGKSQEKGVELAVFISDQVPEKLIGDPGRFRQIITNLMGNSIKFTEKGHIFVTVHLAQEVMDSLDVETESSSKNTLSGFQVAERRLSWAKFKTFSQHERVCSYPSSTYDLINLIVSVEDTGVGIPFEAQCRVFTPFMQVGPSISRTHGGTGIGLSISKCLVELMNGEVGFVSIPNVGSTFTFTAVFNNGHSNLNEYTCQQMNNQSNSANSEFEGMSALVVDPRSVRAKVSKYHVQRLGIQVEIVSDLNQVLSSLKSRKPRIDMVLIEEEVWNNDSDLSILFVDQLRHIDQKVTPRLFLLAKSISSTRSDNVTCDTHSPAVIMKPLRASMVAACLQRTMGNMGNKGNYRNGEVSRLSLQHLLLGRKILIVDDNKVNLKVAAGALKRYGAELVCVESGKEAISLLTPPHSFYACFMDIQMPGMDGFEATKTIRDVEKSVNRKIQLGEVSAEAHGNVLNWHVPILAMTADVIHATQEECMKCGMDGYVSKPFEAEQLYREVSRFSYSAESRKL

SEQ ID NO: 958 - protein, 890 aa, Eucalyptus grandis
HEQPSAIDQKTFGEYTERTAFERPLTSGVAYALKVPHSEREQFEKRHDWTIKKMETADQTLVPDYMLDRLDPAPIQDEYAPVVFSQETVSHIVSIDMMSGKEDRENILRARASGKGVLTSPFKLLKSNHLGVVLTFAVYDRELPADATAEQRIEATVGYLGASYDVPSLVEKLLHQLASKQTIVVNVYDTTNGSAPINMYGDDVIDTGLVRVSNVDFGDPLRRHEMHCRFKQRPPLPWTAINSSVGLLVITLLVGHIFHAAINRIAKVEEDYRQMMELKSRAEAADVAKSQFLATVSHEIRTPMNGVLAMLQMLMDTNLNANQLDYAQTAHACGKDLISLINEVLDQAKIESGRLELEKVPFDLRLALDNVLSLISGRSNEKGIELAVYVSDRVPEAVIGDPGRFRQIITNLVGNSIKFTHEGHIFVSVHLLEEGCSQHDFRDVEKRLSSNLVEDTSDKTFNTLSGFQVVDRRKSWERFKKLNRSDQIDVNESVEVLVTVEDTGVGIAREAQSRIFTPFVQADSSTSRTYGGTGIGLSISKCLVDLMHGEIGFVSEPGTGSTFSFTVPFAKCEMNCLEVKGQNYDSIISEFRGLRALVIDKRHIRAEVARYHLERLRISVDVACSLKSACTYLSNSSSPRELSDFDMVLIDKDVWDRQTGLELNISLWKHRQNGSNGVSIRPKIFLLATSISPIEHSELKLANLVDNVLAKPLRLSVLISFLQEALGNGKKRLSDRRKVSTLGSLLKGRRILVVDDNLVNRRVAEGALKKYGAIVTCVGSGKDAVAKLQPPHDFAACFMDLQMPEMDGFEATRQIRHLESEVNSKIASGEVSSDAFQNVVHWHTPILAMTADVIQATNEECLKCGMDDYVSKPFEEEQLYSAVARFFESG

SEQ ID NO: 959 - protein, 264 aa, Eucalyptus grandis
AERAGHCKIDDKRGRQWHIMHVTPESEPREPSPVQEEYVRYEFGEDDNAYMGPLLSSLGMMTGEEDRHHVLKARAVEKAVLSAPFRLFSSNRTGVILIYPVYKSKFSPSVSLEERIRATAGYIGGLFEFESLVESILWQLGNQTVLVKVYDITNCRPSLMYGPNYVKFDRTMAHMSKLELGDPFRKYLMICRYQDEASKSWLPAIAVVLIVTIGLLAPCVLYAAAIHVAKLRQASLQIQGLEVQLQDANMANSQRLLPCFSRLN

SEQ ID NO: 960 - DNA, 4019 bp, Eucalyptus grandis
cagggattgaattctgttaaaaaaaaaaaaaaaaaactggtattgcaacaccaacgaccatatgctctgatttctcgaccccgcctgtttcgccgatggggacgcctttaaggaaggtgttcgagaggatttcgggcctcgcctatccttggagaagggggagggcgccacagggccgccatcgggttttccgtagagatgtgcagcaagatgattttcagtatgcaagcgctcgttgcctgtcgtcatactacagcgtctttgtggctcgcttggccatcatggttatgctggcaattttaattgggttgctcacaatactaacatggcatatcaccaaaacctatacgacaaagtctctgaacagcttagcatacggactgcgtcatgagctcttacagcgtcccatattacggatgtggaacatccttaattccactgttgaaataacaactgctcaggttaagctctcggaatatgtgatccggcggtacagtaaacctgacactcaggccgaacaagtccagctgtatgaggcaatgagagatgtcacatgggcgctgtttgtgagccgtaaagcgctcaacgcgataacaatcaattaccggaacggctttgtccaggctttccatagagatcataggagcagcaacacgttctacatatactccgacctgatgaactattcaatcagcaccagcaggccttccaacctcaatatgctttcgtcactccatggatggaacgaccaaacaatccatggcaacacatcggcgacttggtaccgtgtatctctcgaccccgtcacaggcgagaggataggcaaaccaaggacaatactgcccgatgatctcatcaacattgctgggctttctcaagtccctgatggggtagcatcttggcacgtggctgtgagcaaatactcagactcgccgctgctttcggcagcgttgcccgtgtgggatccttccaatgagagcatagtggcggtcgtgggtgtgaccacagcgctttatagcgtcggccagctaatgaaggagcttgttgagtttcatagtgggcacatttatttgacatctcaagaaggttacttgcttgccacttccagcaacactcctctcttgatcaattcgacaaaagggccgaagcttatgatggctaaccattctcaagatcaagtcatacagttgggagccgagtggctgcagaggacctatggaaacagttttcctgcaaatcatgaagttcatgtagagaatgccgaacttgatcgccagcactattacattgattccttctttctgaatttaaaaagactcccgatggtgggagtgatcatcataccaagaaaatatatactggggaaggtggatgagagagccttcaaaacattggtcatactcatatctgcttcgctatgtaccttggtgattggatgcctctgcatttttttactgacaaatggagtatcaaaggaaatgaaactgagagcagaacttataagccaccttgatgcaaggaggcgagccgaggcatcaagcaactacaaaagtcaatttctggcaaatatgagtcacgaattgcggacgcctatggctgcagtaattggattgctggacattcttgtttgtgatgattgcctaacgaatgaacaatactcaacagtcacccaaattcgaaaatgctcaaccgctctgctcaggctgctgaacaatatattggatcttagcaaggtggagtctggaaaactagtgctggaggaggcggagttcaatttagcacgagaactggaaggacttgtcgatatgttctcggtgcagtgcattaatcacaacgtggagactatcttagatctttctgatgatatgccaaagttagttcgaggggactccgctagggttgtccagatatttgcgaatcttatcagcaattcgctcaaatttactccatctggtcatattattatacgaggatggtgcggaaactcaaggaccatgagtgactttgtaaagctgcctcttgagcataaaatatccatttcttcacttaagacaaagttgaagcaacatggtagtcacgcaagaagggcatccaagaaagacaacaaagtgaccctctggttcgaagttgatgacactggctgtggaattgatccaagcaaatgggaatccgtttttgaaagctttgagcaggccgatccatcaacaactcgattacatggcgggactggtcttggcctatgcatcgtacgaaccttggtcaacaaaatgggtggagaaatcaaagtcatcaagaagaatggcccgggaactctcatgagactttacttactcctcaatgcacctgttgatggcacggaacataactgctcagtggattatgccgtgcacaacataagagtgctactcgcacaacatggaagcacgggtagatttataatgtctggatggctgcgcagaaatggagtttccactctggaagcatctggatggaatgaattgacccagattcttcaggaactctaccaaggcagaaattcaggtgctccatacaggactgttaatacggaacatgcacatgaactcccgagatcagaagtgacaactttcgatgatattcaaagtgagatcctcatcatagtcgtggatatagagctacttgacctaaacacagatatatggaaggaacagctcaatttcctggacaagtaccacaggaaggcaaagttcgcgtggatgctaaaccatgacaccttcaatgccattaaggtggagctccgaaggaaaggacacatgctgatggtcaacaagccgctatacaaggccaagatgattcaaattctggatgctgccataaaggagaggaactctgaactcctgaaaagggcctccaattcttcaaaaagcatgaataaagaagaggacttgcacgagtgtctagaaatcgactctgagcactatgagggagcgagctctgatgaactggacacagttgaaacatcacgttctggttgtaccaatacatctcctggtgaacaaaagcaacaggaagggatcaaaacccctcctgctctacaacacaggacatcgaactatcactcattcaattctactctgctgtcttccgactataacaatttagggaacaaagaagaagcgtgtccaactagtccccctttggaccacccagataatgccgaaggcagattcaagtgcacgaggagcgtgttttcttcaaaagaaaaggaagatggaaattcagaagcacaggaacaacttctgatcagcaagcgtcctccagccaaagttgattcgtgttccagtaaagaattggaccagaaagggtctctggagggcctgtgcatactacttgccgaagacacgccagtgcttcagagagttgctacgatcatgctggaaaagttgggggctaaagtcattgctgttggagatggcttgcaggcggtgaatgccctgaacagcagtctagatgtagatgcagaagacttcaggacgacgttgcatttgcaaaacgcgaacaggatgcctcaagcaggaacacgaagttggcaaccttacgacctgatccttatggactgtcaaatgccccagatggacgggtacgaagcaacgaaagcaatcagaagatccgaggccggaagcggcctgcacattccgattgttgcgctgaccgcgcatgccatgtcatcagatgaagccaagtgcttggaggtgggaatggacgcatacttgacgaagccaatcgactataagcttatggtgtccacaattctgtcgctcaccaagggagtcaactgagagaacctgctaagacaacttagagagaaccaaagaaagccagattctaaagtctacacagtttttgcttttgaaatgtgaaagaatcagtatgattaacgaactgggcaagtataccagtgaccccatctgcaatctgtaaagacatctgagtttctctagcttatttctgagcatattcggaaaaaaaaaaaaaaaaaa

SEQ ID NO: 961 - DNA, 3939 bp, Eucalyptus grandis
ggcacgaggtcttggagtttgagctctctctccatcttttgagagccatgctcgtctctatgtgactcgagacaagctcgtctttttttgaattcttcttgctttcctctctttagaaagctctactaccattgggtttctagagagagagagaatgtgcgagtgtgcgtgtgtatgtgtgtgtttgtagagtctagagtgcgcgcgcgctagccttgagaaacagattttatctaacacctttttttacttgttttcccttttcattcgttgccccttttcgctttctgttctttctttgaatgctgtctgcaaaataatttcctttgggttcatctttactctttttgtccggaaaagagtgctccccgaaaatcatcattacttttgtaattcagctgcgtaaacaagtcctgagcttttctgagctatagcatgaagtgggtatctggaaaacaaggaggaaaagaagaggaacagcaagaagaaggaaaagctcaacagaggagaagcagaatctgacacaaagctttacacagaggcagtgaaaggatgggggtgaaaatgcaacagagccaccatttggtggccgtgaagttgaatgagcaagtgggaaccaaaagagggtacacattcattcagtcgaacagggcttggattcccaaaatcttggtcctttcggtggtggggatggcattcttgagcatgtcgatctacagaaaaatggacgctgacatcaaggtgaggaggaaggaggtgctggttagcatgtgcgatcagagggcaaggatgttgaaggaccagttcagtgtcagtgttaatcatgttcatgccttggccattcttgtctcaactttccattactacaagaacccatctgccatcgatcaggaaacatttgccgagtacacagcaagaaccgcttttgagcgccctctactgagcggtgtggcgtatgcggaaagagtgactaattcggagagggagaaattcgaagagcaacatggatggacaattaagacaatggagaagcagccttctcctgttagagatgaatatgcgcccgtcattttctctcaagaaaccgtatcctacattgaatcacttgacatgatgtcaggagaggaggacagagaaaatattctaagggcgagggcaactggaaaggctgttctgacaagcccattcaggttgttgggctcccaccatttgggggttgtattgacgtttcccgtgtacaagtcaaaactcccgccaaatccaactgtggaagagcgcattgaggcaactgtaggatatcttggaggagcatttgatgtcgaatctctcgtggagaatctacttgggcagcttgatggaaatcaggcaatcttggtcaatgtatatgatgtgacaaactcttccgaaccacttatcatgtatggtcaccaatatcaagagtgtgatacatcccttctacatgagagcaagctcgactttggtgatccgtttaggaagcatcagatgatttgtagatatcatcagaaggcaccaccatcatggacagccctcactactgcattttttgtctttgtgataggcttattagtagggtatattttgtatggtgcagcaactcacattgtcaaagtcgaagatgattttcatgagatgcaggaactgaaggttcgagcagaagctgctgatgttgccaaatctcagtttcttgccactgtttctcatgagattagaactccaatgaatggcatccttggaatgcttgctctgcttcttgacacagaattgagttctactcaaagagactatgcacaaactgctcaaatctgtggaaaagcattaatagcactgataaatgaggtacttgaccgtgctaaaattgaagcgggcaagttagagctagagacggtcccattcgacattcgatccattcttgatgatgttctctccctattctctgaggagtccagacacaaaggtattgagcttgctgtctttgttgctgacaaagtgccggaaattgtcatgggggatccgggaagattcagacagataattactaaccttgttggaaactctgttaaattcaccgagaagggacatatatttgtgaaagtccatctggctgaccaagtaaagggtgcgactaatgcacacgctaaaacttgcctaaatggacgaccagaggaagatatactgatttctgatgggtcacagttggaaacattgagtggatgcgaagtagccgatgagaggaacagttgggatacctttaaccttttggtagctgaagaccagttcaattccgttgattccaacatgactagtaacgaagcttctgaaaatgtcacggtaatggtcagtgttgaagataccggcatcggcattccattgcgggcccaggatcgtgtatttatgcccttcatgcaggcagatagctcaacttctagaacttatggtggaactgggattggcttgagtattagcaagtgtctggttgagctgatgggtggacacataaacttcataagccggcctcagattgggagcacattctcctttacggctgtgtttggaagatgcaaaaggcttgtgtttgctaatgtgaaaaggacttttgaagatcttccttctggttttaaaggattgaaagcaatagtggttgatggtaagccagtcagagctgccgtaactagataccatttgaatagacttggcattaacgttgaagttgcaagtagcatcaatgctataacagctacgggcgggaaaaatggttctctgactgctggatatcggcacccagacataattctagttgagaaagatatgtggatgtccagcattgacagctggataagtttaacggtggcagactggaaacagaatggcaatttaattcagcttccgaaaatcctcctcgcaagcaaaatcagtgcttctgaactagagaaggcgaaagcttctggttttgccgatactgtcattatgaaaccagtgagagcaagcatgcttgctgcatgtctgcaacaggttctgggcatcggaaggaagaagcaattgcagaaggatatgaacatgcgaaatggatctagcgccctgcggagccttctctatggcaagaagatattggtggtcgatgacaacaaggttaatcgaagagttgcagcaggcgcactcaagaaatttggggccaatgtagagtgtgcagagagtggaaaagctgcattagagttgcttcaactgccacatgactttgatgcttgtttcatggatatccaaatgcctgaaatggatggatttgaggcaacacgacagattaggctgatggagagccaggtgaacgagcaaatgaaaagtgaatctgcagttcaaatcgtaaaagggggtgagtggcacatgccaatattggcaatgacggcagacgtgattcacgcgacttatgacgaatgccttaaatgcgggatggacgggtacgtctcaaagccctttgacgaagagaatctttaccaggcggttgccaaattctttaggaccaaacccgtctaggacttgaaaacttccaagtgtctggtgaattcatggatgtcacaactcagatgttgcagtgaaaaaaagtgaccagcgattttgtattctgctggttggtttttcatgtcgataatggccccactcaaaaatgccggcactggtaaattgttcttacctgactcaaatcattattttaactagagtagaatgaatcggagtatttgtatactaccatagaacatccagccctgcttgtctgtatagatcttaaaggaggggcgaggagtccaaaaggtgtatattttcatcgtcgtaaaaaaaaaaaaaattttttctcagaaatctctgaaccacttaatacaatctggaaatgctcttttcaagctttccttcattaaaaaaaaaaaaaaa

SEQ ID NO: 962 - DNA, 3931 bp, Eucalyptus grandis
ggcacgaggtcttggagtttgagctctctctccatcttttgagagccatgctcgtctctatgtgactcgagacaagctcgtctttttttgaattcttcttgctttcctctctttagaaagctctactaccattgggtttctagagagagagagaatgtgcgagtgtgcgtgtgtatgtgtgtgtttgtagagtctagagtgcgcgcgcgctagccttgagaaacagattttatctaacacctttttttacttgttttcccttttcattcgttgccccttttcgctttctgttctttctttgaatgctgtctgcaaaataatttcctttgggttcatctttactctttttgtccggaaaagagtgctccccgaaaatcatcattacttttgtaattcagctgcgtaaacaagtcctgagcttttctgagctatagcatgaagtgggtatctggaaaacaaggaggaaaagaagaggaacagcaagaagaaggaaaagctcaacagaggagaagcagaatctgacacaaagctttacacagaggcagtgaaaggatgggggtgaaaatgcaacagagccaccatttggtggccgtgaagttgaatgagcaagtgggaaccaaaagagggtacacattcattcagtcgaacagggcttggattcccaaaatcttggtcctttcggtggtggggatggcattcttgagcatgtcgatctacagaaaaatggacgctgacatcaaggtgaggaggaaggaggtgctggttagcatgtgcgatcagagggcaaggatgttgaaggaccagttcagtgtcagtgttaatcatgttcatgccttggccattcttgtctcaactttccattactacaagaacccatctgccatcgatcaggaaacatttgccgagtacacagcaagaaccgcttttgagcgccctctactgagcggtgtggcgtatgcggaaagagtgactaattcggagagggagaaattcgaagagcaacatggatggacaattaagacaatggagaagcagccttctcctgttagagatgaatatgcgcccgtcattttctctcaagaaaccgtatcctacattgaatcacttgacatgatgtcaggagaggaggacagagaaaatattctaagggcgagggcaactggaaaggctgttctgacaagcccattcaggttgttgggctcccaccatttgggggttgtattgacgtttcccgtgtacaagtcaaaactcccgccaaatccaactgtggaagagcgcattgaggcaactgtaggatatcttggaggagcatttgatgtcgaatctctcgtggagaatctacttgggcagcttgatggaaatcaggcaatcttggtcaatgtatatgatgtgacaaactcttccgaaccacttatcatgtatggtcaccaatatcaagagtgtgatacatcccttctacatgagagcaagctcgactttggtgatccgtttaggaagcatcagatgatttgtagatatcatcagaaggcaccaccatcatggacagccctcactactgcattttttgtctttgtgataggcttattagtagggtatattttgtatggtgcagcaactcacattgtcaaagtcgaagatgattttcatgagatgcaggaactgaaggttcgagcagaagctgctgatgttgccaaatctcagtttcttgccactgtttctcatgagattagaactccaatgaatggcatccttggaatgcttgctctgcttcttgacacagaattgagttctactcaaagagactatgcacaaactgctcaaatctgtggaaaagcattaatagcactgataaatgaggtacttgaccgtgctaaaattgaagcgggcaagttagagctagagacggtcccattcgacattcgatccattcttgatgatgttctctccctattctctgaggagtccagacacaaagcttgctgtctttgttgctgacaaagtgccggaaattgtcatgggggatccgggaagattcagacagataattactaaccttgttggaaactctgttaaattcaccgagaagggacatatatttgtgaaagtccatctggctgaccaagtaaagggtgcgactaatgcacacgctaaaacttgcctaaatggacgaccagaggaagatatactgatttctgatgggtcacagttggaaacattgagtggatgcgaagtagccgatgagaggaacagttgggatacctttaaccttttggtagctgaagaccagttcaattccgttgattccaacatgactagtaacgaagcttctgaaaatgtcacggtaatggtcagtgttgaagataccggcatcggcattccattgcgggcccaggatcgtgtatttatgcccttcatgcaggcagatagctcaacttctagaacttatggtggaactgggattggcttgagtattagcaagtgtctggttgagctgatgggtggacacataaacttcataagccggcctcagattgggagcacattctcctttacggctgtgtttggaagatgcaaaaggcttgtgtttgctaatgtgaaaaggacttttgaagatcttccttctggttttaaaggattgaaagcaatagtggttgatggtaagccagtcagagctgccgtaactagataccatttgaatagacttggcattaacgttgaagttgcaagtagcatcaatgctataacagctacgggcgggaaaaatggttctctgactgctggatatcggcacccagacataattctagttgagaaagatatgtggatgtccagcattgacagctggataagtttaacggtggcagactggaaacagaatggcaatttaattcagcttccgaaaatcctcctcgcaagcaaaatcagtgcttctgaactagagaaggcgaaagcttctggttttgccgatactgtcattatgaaaccagtgagagcaagcatgcttgctgcatgtctgcaacaggttctgggcatcggaaggaagaagcaattgcagaaggatatgaacatgcgaaatggatctagcgccctgcggagccttctctatggcaagaagatattggtggtcgatgacaacaaggttaatcgaagagttgcagcaggcgcactcaagaaatttggggccaatgtagagtgtgcagagagtggaaaagctgcattagagttgcttcaactgccacatgactttgatgcttgtttcatggatatccaaatgcctgaaatggatggatttgaggcaacacgacagattaggctgatggagagccaggtgaacgagcaaatgaaaagtgaatctgcagttcaaatcgtaaaagggggtgagtggcacatgccaatattggcaatgacggcagacgtgattcacgcgacttatgacgaatgccttaaatgcgggatggacgggtacgtctcaaagccctttgacgaagagaatctttaccaggcggttgccaaattctttaggaccaaacccgtctaggacttgaaaacttccaagtgtctggtgaattcatggatgtcacaactcagatgttgcagtgaaaaaaagtgaccagcgattttgtattctgctggttggtttttcatgtcgataatggccccactcaaaaatgccggcactggtaaattgttcttacctgactcaaatcattattttaactagagtagaatgaatcggagtatttgtatactaccatagaacatccagccctgcttgtctgtatagatcttaaaggaggggcgaggagtccaaaaggtgtatattttcatcgtcgtaaaaaaaaaaaaaattttttctcagaaatctctgaaccacttaatacaatctggaaatgctcttttcaagctttccttcattaaaaaaaaaaaaaaa

SEQ ID NO: 963 - DNA, 5110 bp, Eucalyptus grandis
ggcacttcttttggcgatacaggggccatgagaggaggaaagagcacatacacagagaaaaggtccaaagtttttcttacctcattaatgattctctcacaggtttgctagccacggcaacagctggttcctttgggtacagctaagttgttttggaatgattatctcctactttatcttcttcaaaagaggtgtgctctcgatggcctttcgggcttctcaggacgtggtctcagaaatttaaaacagaacaagaaattacacaccggaaggagatcaagaaaaggcaaggacctgctgcttcgtttgctggtatagcatattaactagagcatggggctcgtctcgtctggtcgcttctcaagaatcacagagcattgaaatttttgtccgggtcgcgctgaggcggttgagctcaagctattgatgagtttgtcacctctagttggagttcttcttaggctatcaactctctttgttgagtggcctatgggaaagatgcatcctaatggcaagcttgccggatctaatggcaaattgcaagcgagcttcaagttggataaagggaacgcgcccatcaaagctcacaattgtatggaaagatggaggagaaagctcatattcgtttgtcttctgcttatggtcgtctctgggtttgtttggtttttctcgggtttcagtgagagttctttggtggggaaggcgaaagacccggaactgtgggaggaaaaagctcgaatctttatacagcatttcaatgtcagcaagaaccaactccatgctttagtttctctgctcgatgactccaaacaggtagcatccatccaatgttccaaattactcaaagaaatgggaaaggaaatggcatttataaatggttgtgcctgctctctaaaagtcgattgctcagaacatctggatcttctgaaacagcaagtattgaatggggaagatgctgaatttgaggaccagtgcccggttcaacctgagaatctctcctgggaggattgcctgtcaatgctacaggaaaaatcaattgcaactgcttcgctatctgaaatttcattccaatcagtcaataatccaaactttctggaggacatgtcacaagcaagggggaagggaaatcatgcaggagatagctgcgggactaggtcctttggtttagtaaaaggatgctggtgggttatttttgtgatgatagtgatctgcaaggtgtgtggtttttatatgagagttcagagggaccaaacacaaaaaacagttaagccaaagccagtgagtcagcagcgggagctgctgcttcagcagaggcagcaacagcaaaaccatagttcctccaaaagtgctgggaggtggcgaaaaaaacttttaattgtatttgttgtagctggagtaatgacgtccatttggttgttttggcatttatatgctaaaaatgttctgaggagagaagagaccctggccaacatgtgtgatgagcgagccaggatgctgcaagatcagtttaatgtcagcatgaaccatgttcatgccttggctattctcgtttccacctttcaccatggaaaacaaccgtcagctatagatcagaaaacttttggagaatacacagaaagaacagcttttgagagaccacttactagtggtgttgcgtatgctttaaaagtacctcactcagagagggagcaatttgagaagcgacatgactggacaataaagaaaatggaaactgccgatcagacacttgtgccggactatatgctagataggttggacccggcacctattcaagatgagtatgcacctgtcgtattttctcaagaaactgtctctcacatagtctccattgacatgatgtccggaaaggaagatcgggagaatatactgcgggctagggcatctgggaaaggagtactgacttctcccttcaagcttctgaagtcaaatcaccttggtgttgtactaacttttgctgtatatgatagagaactgcctgctgatgctacagctgagcaacgtattgaagcaacagtggggtatttgggtgcatcttatgatgtcccttccctagttgagaagcttctgcatcagttggccagcaagcagacgattgtcgtaaatgtctatgacacaaccaatggatctgcaccaatcaatatgtatggtgatgacgtcattgacactgggctggttcgcgttagtaatgttgattttggggatccacttaggaggcatgagatgcactgcaggttcaagcagagacctcctttgccgtggactgcaataaattcatcagttggactgctggtcatcacgttgcttgtcggccatatttttcatgcagctataaatcgaattgctaaggtggaggaggactatcgacagatgatggagctgaaaagtcgtgctgaggctgcagatgtggcaaaatctcagtttcttgcgactgtttcccacgagattagaactcctatgaatggtgttttagccatgctgcaaatgcttatggatacaaatctcaatgcaaatcaactggattatgcccaaactgctcatgcatgtggaaaagatttgatatcactgatcaatgaggttcttgatcaggccaagattgaatctggacgtctcgagctagaaaaagtgccttttgatcttcgtttggctctggataatgtgctatcacttatttcgggcagatctaatgaaaaaggaattgagttggctgtctatgtctctgatcgggtaccggaagctgttattggtgatcctggtcgattccggcagataattacaaatcttgttgggaactcaatcaagtttacacatgaagggcatatatttgtctcagttcatctgctagaagaaggatgcagtcagcatgattttagagatgtggagaagagactaagttcaaacttagttgaagatacatcggacaaaacttttaatacattgagtgggtttcaagtggttgacagaaggaaaagctgggagcgctttaagaagttaaatcggtccgatcaaattgatgtgaatgaatcagttgaagtacttgttactgttgaggatacaggtgttggaattgccagagaggcacaaagccgcatattcacaccttttgtgcaggctgatagctccacatcacgtacatatggtggcactggaattggcttgagtattagcaaatgtctagtggatcttatgcacggggagatcgggtttgtaagtgaaccgggcactggaagtacattttcctttactgtaccctttgcaaaatgtgaaatgaactgtcttgaagtgaaggggcaaaattacgattcaatcatatcagagttcagaggattgagagccttggtgatagataaaagacacatccgagctgaggtcgcaagatatcatcttgagagactaagaatatcagtggacgtcgcttgcagtttgaagtcagcctgtacttacctttccaactcttctagcccaagggaactatcggattttgacatggttctcatcgacaaagatgtttgggacaggcaaacaggtttagaactcaatatttcactttggaaacacaggcaaaatggcagcaatggagtgtcaatacgtcccaagatttttcttctggctacatccattagtccaattgagcacagcgagctcaaattagccaacctggtagataatgtgctggcaaagcctctcagattgagtgtcttgatatcctttctccaggaagccctcggtaatggtaagaagaggctatctgataggagaaaagtatcaactcttggcagtttgctgaaaggaagaagaatcttggttgtggatgacaacttggtaaacagaagagtagcagagggtgctttaaagaaatatggtgccattgttacctgtgttgggagcggtaaggatgctgtggccaagcttcagccgccccatgacttcgctgcttgcttcatggatttgcaaatgccagagatggacgggtttgaggcaacacgacaaattcgtcacctcgagagtgaggttaatagtaagattgcatctggggaagtatcttccgatgcatttcagaatgtggtacattggcatactcctatcttagccatgacagctgacgtaattcaggctacaaatgaagaatgcctcaaatgtggaatggatgattatgtctcaaagccttttgaagaagagcagctttattcagcagtagcacggttctttgagtctggctgagagataacgatatgatggcagcacatctactgtcaaaagctccacgtcagtggctgatcacttttcacaacttcgctggggcttgcccttttggggcgggggacatcaaatggttgtcatgacgtgccttgtgcattgtacagctatggtctttcctggtggcattcttggagttccaggagctatgagtttgctgccttaactgatggactcaaatatttgattctgggcagcagtatactggcgtcatggcgcatcctgatctgtcaacattgatataggatttgttcttttctcagaatagattcaacaaaagggcgtggcttggggattgttcagagtcccagctagcctggttgcagagtggaactcagctctgcagatcctactaccgtgctgcagctaaaagtgagcttcgaggaggatgaatgaccattattttttacccttggaggtgtgcctctctgagatgcatcgtggacccccaagttgttgagattgatttctcgggcatgtcagcccttctgtcagatgtagaagggagttgagttcctcattcttttcccctcgccggtggacgtctctccgatgcttaataaaggattgtattcttttggacactgaagaataaaattgtcaagcgtattttctaccgtggtggaagaatatagttagtttttgtttcctattatagagtgttgatccctgttccagcaaaaaatgacccagctgaaagggtctaatctttattaacattatcacaaacgcattctcaatctcgtgtggatatcataatgtggagattactgtggttctattatccccacagagaatgatatgtgactttggatagaaaaaaaaaaaaaaaaaa

SEQ ID NO: 964 - DNA, 1406 bp, Eucalyptus grandis
gcggccgcgtcgacttgaaatttactccctcaaatgccccttctttttcttttttgttttttcgtttgatttcgcattgcttgtcctgtaattgaaaatcaagttggaagatttgggatgaaatctggtcagatcttgctttgtggggggtgtggattttggtgggtcttgttttttttcaatacaaagcctcttccctcctccttcctcctccttccctattaagtacacaaaagaaccgaaccaccaaacaaccaccgaaggcaaactaaaccacttctctcctctctctcatctcctcctcctcctcctctctccttctgaatctcatctcattcagatcttacattggtcccgaatgggcatggcagcagcagagtcgcggtttcatgttttagctgtggatgacaacatcatagacaggaagctgattgagaggctccttaagacctcctcatatcaagttactacagttgattccggtagcaaagctctagaatttctgggcttgcacgaggatgatcgaagcaactccggttccccatccattttgacaaacaatcatcatcaggaattggaagtgaatctcatcataacggactactgcatgcctggaatgacgggctacgacttgctcaagaaaatcaaggaatcatcgtctctgagggacatcccagtggtcatcatgtcatctgaaaatgtccctgcaaggatcagcagatgcttagaagaaggagcagaagaatttttcttgaagccagtgaggaaatcagatctgaacaggctcagaccccatgtgatgaaagccgtatctaaggatcagaaacaagagaaacacgaagaagaagaagaagaagaaaaacaggaagaaaaagagattaagtcgcaaaagcatcaagaacagcaacagcaacaacatcaacaacaattatcgccgagaccatcaggcaatagcaagagaaaggccatggaagagaatctttcgcccgatagaacaaggcccagatacagtgacattgctgctgtcgtctgatcaagccctccccaggaatttctttctttttttccccaacaaaaaccgtatatacagaagaagggctttcaatgctggatcatacacacacaaggttaaacagaagatggagagacagttcctttcgtgtacacacattctgcatggagataaaagaggttcctgcccaattttgcttttgaccatatggaggatggatcatcactcatcagaaaaaagaggaaaacataagacagagagagagagagagagagagagagggattagagttgatggttttattttgtttggtggcttctctcttgctcctccattaaaagctttgtgaggtgtagggttaatcgtctcctccttcctcagtccacgcggccgc

SEQ ID NO: 965 - DNA, 899 bp, Eucalyptus grandis
gtttttgtcgtgccggagactcggtcatgaagcttacactcatggatgggtctctctaataagtgtcttccatgtaaacgctgttgtactttagcttttgaactttaaccatgtcctccctccctctccgcctcagctcgcttcgagaatgtccccagttgaggttgcacgtaatgctattgaggatgctcgtgctatttgtttgcgcgagtatggcagtgctccggatattaatatatatggggatcccagctttacattcccgtatgttccaacacacttgcatctaatggtatttgagttggttaagaactctttgcgtgctgtccaagaacgattcatggattcagataaagttgcacctcctattcgaattattgttgctgatggagacgaagacgttacaatcaaggtctcagatgaggggggtggcatcccaagaagtggtcttcccaaaatcttcacgtatctgtatagcactgcgaaaaaccccctggatgagaactcagatcttggaatagctgataatgtgactatggccggttatgggtatgggcttccaatcagccgtctgtatgctcggtacttcggtggtgacctgcaaattatttctatggaaggatatgggactgatgcatacctccatttatctcgcctcgcagattcgcaagaaccgcttccgtgagaaaaactaaagcatgaactcctggttcatgagaacagacttctgggaaatgcccacggaggttcgtcttaaaaagcaagaagcagctgcaattttccatttacaaataacgggtagctttcctgtatattcttccgcatttcaacgtgtcaatgccggcattaacctgtaatccagtgttcgccgttttaggccattcaaaaaaaaaaaaaaa

SEQ ID NO: 966 - DNA, 1472 bp, Eucalyptus grandis
ggcagatccaaaactttctgaagcttatcttcatcgtgcctccacccttcggcggctatgcagataccaggagtcagaatcgagctacagagaatttttggagttaaaacctggaaataaagctgcagaaaaggaactctctcaactatttcaggcacggagtgctctcgaatcagcaatttctctccttgactcaggagattatactaaagctttggaatatgttgataagattgtactcgtcttttctccagcctgctcaacggccaaaattttgaaagtgaagtcgttgttggcaactaaagactattccagtgccatcgctgagtctggatttattctcaaggaagacgagaacaatttagaggcgttattgcttcgtggccgtgcctactattatttggcagatcacgatgtggctatgaggcattatcagaaaggtctccgcctggaccccgagcatgctgacttgaagaaagcatattttgggttgaaaaatttgctcaagaagactaagagtgcagaagataatctgaacaagggcaaattgcgacttgcagtagaggattataaaggagctattgctttggaccccgatcatcatgctcacaatgtacaccttcatcttggtttatgtaaggtgttggtgaagcttggtcggggaaaggaagctttgactagttgcactgacgcacttgacattgatggagatcttactgaagctttagtccagagaggcgaggcaaaacttctaactgaagactgggaaggtgctgtggatgatctaaagtcggcagctcaaaagtcacctcaggatatggctattcgtgaagcacttatgagagctgagaaagcgttgaagatgagcaaacggaaggactggtacaagattttaggaatttcaaagactgcatcaattgctgagatcaagcgtgcctataagaagcttgctttgcaatggcatcccgacaagaacgtggagaatagagaagaggcagagaacaagttccgagaaatcgctgctgcatatgaggtgctcagtgatgaagaaaagcgtaccagatatgacagaggtgaagacattgacgaaatgggcacgggaggtagcggcggcggtttcaacccgtttggcggtgggggacagcaattcactttcaccttcgatggtggttttcccggtggctttggtgggtttcaaggaggaggctttcctggcgggtttgagttccaattttgattccgtcaaaatgcggggatcccgacacgggaggtagacaaattgaatgcatttcggcgacccaaaaccccagctgattaattcctggtaggagctcggtaaatagtttaggtcattcagaaaaatttgtgccaattgaaaaggtaattttcgagaaagtgttgctttgcgggccattgtaaatggaaattttccgagttagtgaaattcaaattcaatcgtttaaaaaaaaaaa

SEQ ID NO: 967 - DNA, 889 bp, Eucalyptus grandis
gccaattcaaaaccacaagctcattggtcaccatccgcaactccagtcttcgagcaggcagggaacaacaggcatggaggtgggtcagatgcagaggaggttggtagagttcaccaaatcattgttcatggagggtttcttggacggtcagtttttgcagctccaacagcttcaggacgagagcaaccctgattttgttgtggaagttgtgtccctcttctttcaggattctgagaagctgctcaatgatctgacgtcggctctagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcgtggcggccggcggttcgatcccggcgatggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctatgtgtttgtaggtctccttaaacaggaacatatttctgtgtagtctagcgtttttggctatatttgggatttaattctgtactttcttaagctgatgggcagtggaggtggccttattacaccacagattttggtgttcaaaagaagagcacaagatcttcctaatgcagaacataacattagagaaaaaaaaaaaaaaaaaaaa

SEQ ID NO: 968 - DNA, 864 bp, Pinus radiata
gcctgcgatattcattctttaccattcgcacattggaggattcaaccgcaaaaattcccaatccttcttgcgtctatcaagggcagatgcagcattaaaagctgagcggccagagttttgagtcgcagagaaccagaaaaaaaatggacgtcattcagttgcagcgcaggttcatcgattacacttcgtctctgtaccgggagggattcctggacgagcaattcacgcaactgcagcaactgcaggacgagagcaatcctgaattcgtggctgaagtggtctcgctcttctttgaagatgccgagaaacttctagcagatttatccaaaacgcttgctcaacagccgattgacttcaagaaagtagatgctcatgtccaccagttcaagggtagcagttccagcataggagcgcatcgagtgaaaaatgaatgtatatcattccgtgccttttgtgaacagagaaacagagaaggctgtctccaatgcttggagcaactgaaacaggagtattacaatgttaagaacaagcttgagactctatttcagctcgagcatcagattctggaggctggtggaactattcccatgtcagagtgagcctttagagattggtaaatctcgctggaccaccatcggctatctgtaaatgtctagacctaggagggaagctgtccaagatgtagttgcaagcatatgttatataaacccatgaaggttttttgacttcagtgcacgggcagctagtgtgttattctattccaactttcatagcatctctctatgatgcatttatagagaagatactcatgtaatcttttctttataattaacctagctggcattttccccgttaaaaaaaaaa

SEQ ID NO: 969 - DNA, 936 bp, Pinus radiata
gaaatttccgagatctcgttctgtatttctctgaatctttcaggctccaccttaattcagcccacgcgaagaagaagaggtagcagagggagggatggcagtttcacagatgcagcagcgttacattaatttcactaattctcttttccaggagggattcgtggatgaacaattcacacaacttcagcagctgcaagatgagagtaatcctgattttgttgcggaggttgtttttttgttctttgaggattctgataaactactggctgacttgtcaaagactctcaatcaggaaccagttgatttcaagagagttgatggctgtgtgcaccaattcaagggtagcagctcaagtataggagcgcggcgagtaatgaatacgtgtgtaacgtttcgtgcattttgtcaagataaaaatagagaaggatgcttatattgtttacaacaaatgaagcaggagtgttacctcgtgaaaaacaagctggagactctgtttcagcttgagaaacagattgtagaagctggtggaactgttcctatggcagagtaagcactgagacataatattccatttctgggataattaagaactggaggaaaaagtgagttacaatcctggagtggctggataacagctagaattaatgctaaaatttccacttttgtttctgtaaattataaatatgttagcatctatcctgaatagatcaacaaagcaagtgtgctatagcgaagaacagctggtggttgtgccagctggtaatgaattccatttctctaagttgtgccatacacacatggaagagtgaaattggcatcagtgatatgggccagtagatgagacctctattaccatgggaggttggttgtctttactctgatgcattatttgcaaggaatgttatgtaatagctgtcaactttactaaaaaaaaaa

SEQ ID NO: 970 - DNA, 517 bp, Pinus radiata
gaagaaaatggatgcccatgtgcaccagttcaagggaagcagttccagcgtaggggcgcagagagtaaaaaatttatgcatagcgttgcgtacattttgtaacgacaataaccgggcagggtgtattcagtgtctgcaacaactcaaggatgaatattatctattcaaggataagctgcaggatctatttcatctggagcagcagatcttgtccgctggtggaacgcttcctatgatggagtaaacgctggaattctatacagtatgcatcagctttcggtgcaatggcgttagtaggactgggccggctaggcttcgtctgtgacaagcccatgatgttagttagcctggcaaatcggaagaaatattgtgataataaatcacatatatgagatagggttatttttgtttttgtaatggatttatttttaagagaattaagctttcatttttatcttcattgtagattttgaagatgttaaaatgaaggttgtttttgaaaaaaaaaaaaaaaaaa

SEQ ID NO: 971 - DNA, 1153 bp, Eucalyptus grandis
cttaaattaattcccatctccccccccccaaaaaaaagtcaatcccgaaaatttggttttttcttcgcttttccccaaatctcgcaacgttccagtgtctctggcttcacactacctttttccgaattcgcttgtttttcccccatcgaaatctttgcagaacgagagagggacgcgcttcgttccgggttgggtgctgaccatgccgagatttcacgggcagagcaaccacgcgcctgtggacatcgtgaaccagcttcagaagcagtacgtcgattacttgagttctcttttccacgagggagttttggacgaccagtttacgcagctgcagaagctgcaggatgagagcaacccagatttcactgttgaagtggcgactctcttcttcgtggattcggacaaactaataaacaatatggccgcggctctagaaagatcacctgttgattttaaacaagtagatgctgatgttcaccagcttaagggcagtagttccagcataggtgcgatgagggtgaaaaatttgtgcattaccttcagaagtttctgtgagacgcagaattatgaagggtgcttgatatgtcttcagcaggtgaaaaatgaatgtgctgtgttgaaggacaagcttcaaaatctattcaggatggagcagcagattgtgggagctggtggttcggttcctctgatggattgacctattgccgggttctttcttgaaggaaaaaaagagaaagggggagagagaagggggggagggaatggagattggagagtacaattgaggctgatgatgggtagttctctttgtagttcatatgtgggctcatttcatggtatgaaccatttctttgggtgtgcttattgatgttgctggaggcataggtgttgcaggtattgctaataagtatctataacatttctgctggtgtcatgttgtttctatgtcgcttcttacatcttctctttggtgtgaaacgtgcacagtattcttgtgcacaaccaattatctcctgattgttactgcacatcctagtgcacattttgccatatatatatgacggacggttactgattgttactggacatatgaagttctttcatgttcaacctcttattgagctaaagttttctgacttgcttaaaaaaaaaa

SEQ ID NO: 972 - DNA, 744 bp, Eucalyptus grandis
ttttgaatgaatgaagaatctctgaaactataacgatggatgtagctcagttgaagcggcagttatttgagtacaccactctactatttcacgagggatttctagatgagcagttcactcagcttcagcaactgcaagatgagaacaacccagactttgttgtggaggtggtgtcactgttctttgatgactctcagaggcttctcaatgagctggccaaagcacttgatcagcagaatatcgatttcaagaaggtggatgctcatgtgcatcagctgaaaggaagcagctccagcatcggcgcacagagagttcaaagagtctgcattgccttccgcaactactgccaggacaaaaatgtcgaagggtgcctgaaatgtctgcaacaagtaaagcaagagtattccctgcttaagaataagcttgagactctgttcaatctggagaagcagattctggcagctggtgggtcagctcctatgtaatgaagtgcgagtggatttagcagattttacaagattgaagaaatgtgactatgagtccatttatttttgcttttatctgaggagagatggtcctttatttgtttttcctctcaacccattttcagcaagagcttgggtggctgcatcagcttttggtcttctctcgtggcaaaatccaaatcaatgaacagtcagaaaagatcaatgtgaataaactcttcatcagcttgtctatgtattgttttggcaataaaaaaaa

SEQ ID NO: 973 - DNA, 693 bp, Eucalyptus grandis
cttatctgcttgtgattcgtgatgggtcgatgtgaatatgggagttttggacgaccagtttacgcagctgcagaagctgcaggatgagagcaacccagatttcactgttgaagtggcgactctcttcttcgtggattcggacaaactaataaacaatatggccgcggctctagaaagatcacctgttgattttaaacaagtagatgctgatgttcaccagcttaagggcagtagttccagcataggtgcgatgagggtgaaaaatttgtgcattaccttcagaagtttctgtgagacgcagaattatgaagggtgcttgatatgtcttcagcaggtgaaaaatgaatgtgctgtgttgaaggacaagcttcaaaatctattcaggatggagcagcagattgtgggagctggtggttcggttcctctgatggattgacctattgccgggttctttcttgaaggaaaaaaagagaaagggggagagagaagggggggagggaatggagattggagagtacaattgaggctgatgatgggtagttctctttgtagttcatatgtgggctcatttcatggtatgaaccatttctttgggtgtgcttattgatgttgctggaggcataggtgttgcaggtattgctaataagtatctataacatttctgctggtgtcatgttgtttctaaaaaaaaaa

SEQ ID NO: 974 - DNA, 1109 bp, Eucalyptus grandis
ctaagatctgccaattcaaagccacaggctcattggtcaccatccgcaactccagtcttcgagcaggcagggaacagcaggcatggaggtgggtcagatgcagaggaggttggtagagttcaccaaatcattgttcatggaggtaaaaagttcaaacttgtaaaatttatgcgcgtttgtatttccttatttgtttctgggttttgtccgattgtgttggtcttgacttcgggaaaattgttctgtttttggttgagaggaagggtttcttggacggtcagtttttgcagctccaacagcttcaggacgagagcaaccctgattttgttgtggaagttgtgtccctcttctttcaggattctgagaagctgctcaatgatctgacgtcggctctgtaatgaaaaattccttgattttacctgatttggagagactgatgttgttggtctattatttgttttggcctttggccatgggacttctctgattttacttctgattttgtcgtccctgcacagagagcagcaaaatgtggactttaaaaaagtcgatgcccatgttcaccagttgaagggcagcagctccagcataggtgcacagagagttaaaaatgcctgcgttgtgttccgcagcttttgcgaagaacaaaacctcgaagggtgcatgagatgtctgcaacaagtgaagcaagagttctaccttgcgaaaaacaagtttgaaactctgttcaccctggagcagcaaatcttggcggccggcggttccatcccggcgacggaaatcacgagtttctaaggatttagaaagaacatcgacgtacccctgctatgccttggagaatccgttaaccgattttgcgaattttcttgggaccataagctcaataagtaaccatgtctctgggtggtctccactgagaaagatgtctctctcttctgtgtttgtaggtctccttaaacaggaacatatttctgtgtagtctagcgtttttggctatatttgggatttaattctgtactttcttaagctgatgggcagtggaggtggccttattaccccccagattttggtgttcaaaagaagagcccaagatcttcctaaaaaaaaaa

SEQ ID NO: 975 - protein, 258 aa, Eucalyptus grandis
GKLNHFSPLSHILLLLLLLLSSSESHLIQILHWSRMGMAAAESRFHVLAVDDNIIDRKLIERLLKTSSYQVTTVDSGSKALEFLGLHEDDRSNSVSPSISTNNHHQELEVNLIITDYCMPGMTGYDLLKKIKESSSLRDIPVVIMSSENVPARISRCLEEGAEEFFLKPVRKSDLNRLRPHVMKAVSKDQKQEKHEEEEEEKQEEKEIKSQKHQEQQQQQHQQQLSPRPSGNSKRKAMEENLSPDRTRPRYSDIAAVV

SEQ ID NO: 976 - protein, 1240 aa, Eucalyptus grandis
MGTPLRKVFERISGLAYPWRRGRAPQGRHRVFRRDVQQDDFQYASARCLSSYYSVFVARLAIMVMLAILIGLLTILTWHITKTYTTKSLNSLAYGLRHELLQRPILRMWNILNSTVEITTAQVKLSEYVIRRYSKPDTQAEQVQLYEAMRDVTWALFVSRKALNAITINYRNGFVQAFHRDHRSSNTFYIYSDLMNYSISTSRPSNLNMLSSLHGWNDQTIHGNTSATWYRVSLDPVTGERIGKPRTILPDDLINIAGLSQVPDGVASWHVAVSKYSDSPLLSAALPVWDPSNESIVAVVGVTTALYSVGQLMKELVEFHSGHIYLTSQEGYLLATSSNTPLLINSTKGPKLMMANHSQDQVIQLGAEWLQRTYGNSFPANHEVHVENAELDRQHYYIDSFFLNLKRLPMVGVIIIPRKYILGKVDERAFKTLVILISASLCTLVIGCLCIFLLTNGVSKEMKLRAELISHLDARRRAEASSNYKSQFLANMSHELRTPMAAVIGLLDILVCDDCLTNEQYSTVTQIRKCSTALLRLLNNILDLSKVESGKLVLEEAEFNLARELEGLVDMFSVQCINHNVETILDLSDDMPKLVRGDSARVVQIFANLISNSLKFTPSGHIIIRGWCGNSRTMSDFVKLPLEHKISISSLKTKLKQHGSHARRASKKDNKVTLWFEVDDTGCGIDPSKWESVFESFEQADPSTTRLHGGTGLGLCIVRTLVNKMGGEIKVIKKNGPGTLMRLYLLLNAPVDGTEHNCSVDYAVHNIRVLLAQHGSTGRFIMSGWLRRNGVSTLEASGWNELTQILQELYQGRNSGAPYRTVNTEHAHELPRSEVTTFDDIQSEILIIVVDIELLDLNTDIWKEQLNFLDKYHRKAKFAWMLNHDTFNAIKVELRRKGHMLMVNKPLYKAKMIQILDAAIKERNSELLKRASNSSKSMNKEEDLHECLEIDSEHYEGASSDELDTVETSRSGCTNTSPGEQKQQEGIKTPPALQHRTSNYHSFNSTLLSSDYNNLGNKEEACPTSPPLDHPDNAEGRFKCTRSVFSSKEKEDGNSEAQEQLLISKRPPAKVDSCSSKELDQKGSLEGLCILLAEDTPVLQRVATIMLEKLGAKVIAVGDGLQAVNALNSSLDVDAEDFRTTLHLQNANRMPQAGTRSWQPYDLILMDCQMPQMDGYEATKAIRRSEAGSGLHIPIVALTAHAMSSDEAKCLEVGMDAYLTKPIDYKLMVSTILSLTKGVN

SEQ ID NO: 977 - protein, 997 aa, Eucalyptus grandis
MGVKMQQSHHLVAVKLNEQVGTKRGYTFIQSNRAWIPKILVLSVVGMAFLSMSIYRKMDADIKVRRKEVLVSMCDQRARMLKDQFSVSVNHVHALAILVSTFHYYKNPSAIDQETFAEYTARTAFERPLLSGVAYAERVTNSEREKFEEQHGWTIKTMEKQPSPVRDEYAPVIFSQETVSYIESLDMMSGEEDRENILRARATGKAVLTSPFRLLGSHHLGVVLTFPVYKSKLPPNPTVEERIEATVGYLGGAFDVESLVENLLGQLDGNQAILVNVYDVTNSSEPLIMYGHQYQECDTSLLHESKLDFGDPFRKHQMICRYHQKAPPSWTALTTAFFVFVIGLLVGYILYGAATHIVKVEDDFHEMQELKVRAEAADVAKSQFLATVSHEIRTPMNGILGMLALLLDTELSSTQRDYAQTAQICGKALIALINEVLDRAKIEAGKLELETVPFDIRSILDDVLSLFSEESRHKGIELAVFVADKVPEIVMGDPGRFRQIITNLVGNSVKFTEKGHIFVKVHLADQVKGATNAHAKTCLNGRPEEDILISDGSQLETLSGCEVADERNSWDTFNLLVAEDQFNSVDSNMTSNEASENVTVMVSVEDTGIGIPLRAQDRVFMPFMQADSSTSRTYGGTGIGLSISKCLVELMGGHINFISRPQIGSTFSFTAVFGRCKRLVFANVKRTFEDLPSGFKGLKAIVVDGKPVRAAVTRYHLNRLGINVEVASSINAITATGGKNGSLTAGYRHPDIILVEKDMWMSSIDSWISLTVADWKQNGNLIQLPKILLASKISASELEKAKASGFADTVIMKPVRASMLAACLQQVLGIGRKKQLQKDMNMRNGSSALRSLLYGKKILVVDDNKVNRRVAAGALKKFGANVECAESGKAALELLQLPHDFDACFMDIQMPEMDGFEATRQIRLMESQVNEQMKSESAVQIVKGGEWHMPILAMTADVIHATYDECLKCGMDGYVSKPFDEENLYQAVAKFFRTKPV

SEQ ID NO: 978 - protein, 480 aa, Eucalyptus grandis
MGVKMQQSHHLVAVKLNEQVGTKRGYTFIQSNRAWIPKILVLSVVGMAFLSMSIYRKMDADIKVRRKEVLVSMCDQRARMLKDQFSVSVNHVHALAILVSTFHYYKNPSAIDQETFAEYTARTAFERPLLSGVAYAERVTNSEREKFEEQHGWTIKTMEKQPSPVRDEYAPVIFSQETVSYIESLDMMSGEEDRENILRARATGKAVLTSPFRLLGSHHLGVVLTFPVYKSKLPPNPTVEERIEATVGYLGGAFDVESLVENLLGQLDGNQAILVNVYDVTNSSEPLIMYGHQYQECDTSLLHESKLDFGDPFRKHQMICRYHQKAPPSWTALTTAFFVFVIGLLVGYILYGAATHIVKVEDDFHEMQELKVRAEAADVAKSQFLATVSHEIRTPMNGILGMLALLLDTELSSTQRDYAQTAQICGKALIALINEVLDRAKIEAGKLELETVPFDIRSILDDVLSLFSEESRHKACCLCC

SEQ ID NO: 979 - protein, 1270 aa, Eucalyptus grandis
MSLSPLVGVLLRLSTLFVEWPMGKMHPNGKLAGSNGKLQASFKLDKGNAPIKAHNCMERWRRKLIFVCLLLMVVSGFVWFFSGFSESSLVGKAKDPELWEEKARIFIQHFNVSKNQLHALVSLLDDSKQVASIQCSKLLKEMGKEMAFINGCACSLKVDCSEHLDLLKQQVLNGEDAEFEDQCPVQPENLSWEDCLSMLQEKSIATASLSEISFQSVNNPNFLEDMSQARGKGNHAGDSCGTRSFGLVKGCWWVIFVMIVICKVCGFYMRVQRDQTQKTVKPKPVSQQRELLLQQRQQQQNHSSSKSAGRWRKKLLIVFVVAGVMTSIWLFWHLYAKNVLRREETLANMCDERARMLQDQFNVSMNHVHALAILVSTFHHGKQPSAIDQKTFGEYTERTAFERPLTSGVAYALKVPHSEREQFEKRHDWTIKKMETADQTLVPDYMLDRLDPAPIQDEYAPVVFSQETVSHIVSIDMMSGKEDRENILRARASGKGVLTSPFKLLKSNHLGVVLTFAVYDRELPADATAEQRIEATVGYLGASYDVPSLVEKLLHQLASKQTIVVNVYDTTNGSAPINMYGDDVIDTGLVRVSNVDFGDPLRRHEMHCRFKQRPPLPWTAINSSVGLLVITLLVGHIFHAAINRIAKVEEDYRQMMELKSRAEAADVAKSQFLATVSHEIRTPMNGVLAMLQMLMDTNLNANQLDYAQTAHACGKDLISLINEVLDQAKIESGRLELEKVPFDLRLALDNVLSLISGRSNEKGIELAVYVSDRVPEAVIGDPGRFRQIITNLVGNSIKFTHEGHIFVSVHLLEEGCSQHDFRDVEKRLSSNLVEDTSDKTFNTLSGFQVVDRRKSWERFKKLNRSDQIDVNESVEVLVTVEDTGVGIAREAQSRIFTPFVQADSSTSRTYGGTGIGLSISKCLVDLMHGEIGFVSEPGTGSTFSFTVPFAKCEMNCLEVKGQNYDSIISEFRGLRALVIDKRHIRAEVARYHLERLRISVDVACSLKSACTYLSNSSSPRELSDFDMVLIDKDVWDRQTGLELNISLWKHRQNGSNGVSIRPKIFLLATSISPIEHSELKLANLVDNVLAKPLRLSVLISFLQEALGNGKKRLSDRRKVSTLGSLLKGRRILVVDDNLVNRRVAEGALKKYGAIVTCVGSGKDAVAKLQPPHDFAACFMDLQMPEMDGFEATRQIRHLESEVNSKIASGEVSSDAFQNVVHWHTPILAMTADVIQATNEECLKCGMDDYVSKPFEEEQLYSAVARFFESG

SEQ ID NO: 980 - protein, 224 aa, Eucalyptus grandis
MGMAAAESRFHVLAVDDNIIDRKLIERLLKTSSYQVTTVDSGSKALEFLGLHEDDRSNSGSPSILTNNHHQELEVNLIITDYCMPGMTGYDLLKKIKESSSLRDIPVVIMSSENVPARISRCLEEGAEEFFLKPVRKSDLNRLRPHVMKAVSKDQKQEKHEEEEEEEKQEEKEIKSQKHQEQQQQQHQQQLSPRPSGNSKRKAMEENLSPDRTRPRYSDIAAVV

SEQ ID NO: 981 - protein, 196 aa, Eucalyptus grandis
LLNFNHVLPPSPPQLASRMSPVEVARNAIEDARAICLREYGSAPDINIYGDPSFTFPYVPTHLHLMVFELVKNSLRAVQERFMDSDKVAPPIRIIVADGDEDVTIKVSDEGGGIPRSGLPKIFTYLYSTAKNPLDENSDLGIADNVTMAGYGYGLPISRLYARYFGGDLQIISMEGYGTDAYLHLSRLADSQEPLP

SEQ ID NO: 982 - protein, 411 aa, Eucalyptus grandis
ADPKLSEAYLHRASTLRRLCRYQESESSYREFLELKPGNKAAEKELSQLFQARSALESAISLLDSGDYTKALEYVDKIVLVFSPACSTAKILKVKSLLATKDYSSAIAESGFILKEDENNLEALLLRGRAYYYLADHDVAMRHYQKGLRLDPEHADLKKAYFGLKNLLKKTKSAEDNLNKGKLRLAVEDYKGAIALDPDHHAHNVHLHLGLCKVLVKLGRGKEALTSCTDALDIDGDLTEALVQRGEAKLLTEDWEGAVDDLKSAAQKSPQDMAIREALMRAEKALKMSKRKDWYKILGISKTASIAEIKRAYKKLALQWHPDKNVENREEAENKFREIAAAYEVLSDEEKRTRYDRGEDIDEMGTGGSGGGFNPFGGGGQQFTFTFDGGFPGGFGGFQGGGFPGGFEFQF

SEQ ID NO: 983 - protein, 151 aa, Pinus radiata
MDVIQLQRRFIDYTSSLYREGFLDEQFTQLQQLQDESNPEFVAEVVSLFFEDAEKLLADLSKTLAQQPIDFKKVDAHVHQFKGSSSSIGAHRVKNECISFRAFCEQRNREGCLQCLEQLKQEYYNVKNKLETLFQLEHQILEAGGTIPMSE

SEQ ID NO: 984 - protein, 151 aa, Pinus radiata
MAVSQMQQRYINFTNSLFQEGFVDEQFTQLQQLQDESNPDFVAEVVFLFFEDSDKLLADLSKTLNQEPVDFKRVDGCVHQFKGSSSSIGARRVMNTCVTFRAFCQDKNREGCLYCLQQMKQECYLVKNKLETLFQLEKQIVEAGGTVPMAE

SEQ ID NO: 985 - protein, 80 aa, Pinus radiata
KKMDAHVHQFKGSSSSVGAQRVKNLCIALRTFCNDNNRAGCIQCLQQLKDEYYLFKDKLQDLFHLEQQILSAGGTLPMME

SEQ ID NO: 986 - protein, 164 aa, Eucalyptus grandis
MPRFHGQSNHAPVDIVNQLQKQYVDYLSSLFHEGVLDDQFTQLQKLQDESNPDFTVEVATLFFVDSDKLINNMAAALERSPVDFKQVDADVHQLKGSSSSIGAMRVKNLCITFRSFCETQNYEGCLICLQQVKNECAVLKDKLQNLFRMEQQIVGAGGSVPLMD

SEQ ID NO: 987 - protein, 149 aa, Eucalyptus grandis
MDVAQLKRQLFEYTTLLFHEGFLDEQFTQLQQLQDENNPDFVVEVVSLFFDDSQRLLNELAKALDQQNIDFKKVDAHVHQLKGSSSSIGAQRVQRVCIAFRNYCQDKNVEGCLKCLQQVKQEYSLLKNKLETLFNLEKQILAAGGSAPM

SEQ ID NO: 988 - protein, 132 aa, Eucalyptus grandis
MGVLDDQFTQLQKLQDESNPDFTVEVATLFFVDSDKLINNMAAALERSPVDFKQVDADVHQLKGSSSSIGAMRVKNLCITFRSFCETQNYEGCLICLQQVKNECAVLKDKLQNLFRMEQQIVGAGGSVPLMD

SEQ ID NO: 989 - protein, 91 aa, Eucalyptus grandis
EQQNVDFKKVDAHVHQLKGSSSSIGAQRVKNACVVFRSFCEEQNLEGCMRCLQQVKQEFYLAKNKFETLFTLEQQILAAGGSIPATEITSF

What is claimed is:

1. An isolated polynucleotide that encodes a polypeptide comprising SEQ ID NO: 914.

2. An isolated polynucleotide comprising SEQ ID NO: 861.

3. An isolated polynucleotide comprising sequences having at least 95% sequence identity to SEQ ID NO:861 and wherein the polynucleotide encodes a polypeptide having receptor-like kinase activity.

4. A genetic construct comprising a polynucleotide according to any one of claims 2 or 3.

5. A transgenic cell comprising a genetic construct according to claim 4.

6. A genetic construct comprising, in the 5'–3' direction:

(a) a gene promoter sequence, (b) an open reading frame coding for a polypeptide encoded by SEQ ID NO: 861; and (c) a gene termination sequence.

7. The genetic construct of claim 6 wherein the open reading frame is in sense orientation.

8. The genetic construct of claim 6 wherein the gene promoter sequence and gene termination sequences are functional in a plant host.

9. The genetic construct of claim 6 further comprising a selection marker for identification of transformed cells.

10. A transgenic plant cell comprising a genetic construct of any one of claims 6, 7, 8 and 9.

11. A plant comprising a transgenic plant cell according to claim 10, or a part, propagule or progeny thereof, wherein said part, propagule, or progeny comprise the genetic construct.

12. The plant of claim 11 wherein the plant is selected from the group consisting of eucalyptus, pine, acacia, poplar, sweetgum, teak and mahogany species.

13. A method for modifying cell signaling in a plant comprising:

(a) stably incorporating into the genome of the plant a genetic construct according to any one of claims 6, 7, 8 and 9 to provide a transformed plant; and (b) regenerating the transformed plant, wherein expression of introduced DNA in the transformed plant affects cell signaling.

14. The method of claim 13, wherein the plant is selected from the group consisting of eucalyptus, pine, acacia, poplar, sweetgum, teak and mahogany species.

15. A method for producing a plant having modified cell signaling comprising:

(a) transforming a plant cell with a genetic construct according to any one of claims 6, 7, 8 and 9 to provide a transgenic cell; and (b) cultivating the transgenic cell under conditions conducive to regeneration and mature plant growth to provide a transformed plant, wherein expression of introduced DNA in the transformed plant affects cell signaling.

16. The method of claim 15 wherein the plant is selected from the group consisting of eucalyptus, pine, acacia, poplar, sweetgum, teak and mahogany species.

17. A method for modifying the activity of a polypeptide in a plant comprising:

(a) stably incorporating into the genome of the plant a genetic construct according to any one of claims 6, 7, 8 and 9 to provide a transformed plant; and (b) regenerating the transformed plant, wherein expression of introduced DNA in the transformed plant affects the activity of the polypeptide.

18. The method of claim 17 wherein the plant is selected from the group consisting of eucalyptus, pine, acacia, poplar, sweetgum, teak and mahogany species.

* * * * *